United States Patent 7,745,391 (HUMAN THROMBOSPONDIN POLYPEPTIDE) - sequence listing, part 150

SEQ ID NO: 387517 - DNA, 3268 bp, Homo sapiens
taaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtctgtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaat

SEQ ID NO: 387518 - DNA, 3214 bp, Homo sapiens
taaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtctgtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagatactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaat

SEQ ID NO: 387519 - DNA, 1221 bp, Homo sapiens
gagagacccaacgggacctcagcccagccagcccaggtgaagcctgaattttataggcaagctgagctgaaaccttgcccttggacaggatccaatcaaaggagatgtatcactttctgtccaacacctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaat

SEQ ID NO: 387520 - DNA, 1134 bp, Homo sapiens
  misc_feature (45)..(45): n is a, c, g, or t
  misc_feature (150)..(150): n is a, c, g, or t
  misc_feature (678)..(678): n is a, c, g, or t
cccagacccggctgacccacctacccgcgatcctgcccatggctnacgggctgtttcggcgcagaccctggggtctcgagcagattcgcccggaccccgagtccgaaggcctgtttgacaagcctcccccggaagaccctcccgctgccngcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccntggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggctcacttctggagctgtgagacccaagacaaaaggggctgagggatttctcattgacaagagttcgtgcgggaaaaccacctgacccctagggatttgtcatcttagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctc

SEQ ID NO: 387521 - DNA, 1482 bp, Homo sapiens
  misc_feature (45)..(45): n is a, c, g, or t
  misc_feature (150)..(150): n is a, c, g, or t
  misc_feature (678)..(678): n is a, c, g, or t
cccagacccggctgacccacctacccgcgatcctgcccatggctnacgggctgtttcggcgcagaccctggggtctcgagcagattcgcccggaccccgagtccgaaggcctgtttgacaagcctcccccggaagaccctcccgctgccngcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccntggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgacccctagggatttgtcatcttagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctc

SEQ ID NO: 387522 - DNA, 348 bp, Homo sapiens
ccaagagttaaatcgacaaaacacagattaacatgagaaaagcatagacatttattcataaatgttttacatggcacaagagccctcataaagaaatgaagacccaaagaatcagttagagtcagttacttctatactggattgaacaaagaataataaactatgaaaatgtgactaaattatgtggggaagcttaaaaaatagaatttctaacaaggtctgtgcaatattctctaagttacctttccttctagtccctagagagtgtctttcacataggaattccatcttctcctcttaagaaacagcacaaaggtcaaagtgatattcttgtacctgctgtttttc

SEQ ID NO: 387523 - DNA, 169 bp, Homo sapiens
tctacaggagtctattactggcatttcgttactcttctgtattcttttcaggggctggttgtgggaagagaggtgatacaaggtgtcattccaggaaggaaagctaggcctaagttctctcctcttctcagtggagtgaggttgttttttgtcttggggtatgtaggca

SEQ ID NO: 387524 - DNA, 743 bp, Homo sapiens
gaaactttcttagatcatcttgttggaggctacgggcctattatggtaactcgcatcagtgttcatatacttgatacgtgaagatcattgctggatctgtaagactacgatgttggtttctacaaacatctataaaacactcacgagagactacgtgatgtattaaataactgccgaaacctgaacttgctatcggtcacttaacattgtgaatcttatccaaagagagttccgcagtctgtagactcagccttgtgcatattatccacgcagctcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387525 - DNA, 517 bp, Homo sapiens
aaatccttgggctatgtcagaggcacaaagtctagaatgttgtatgggtgtgtttaatatatacacaaggaaaatacactcactctataatttcttataaaatagcaagtaaggagtagaagtaggagatgtagaaggggaaagagaattcagaaagtcaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387526 - DNA, 482 bp, Homo sapiens
cctgggtaacatggcaagaccctgtctttactaaaaatacaaaaactagtagggcgtcatggtgtgagcctgtagttccagctaattgggaggctgaggtggaggattgcttgagcccaggaggttgaggctccagtgagccgcgatcaagccactgcactccagcctgggcgacagagaccctgtctcaaaataaaaaaataaaaaataaggcttatttgtacatcccttaaaattagtgctattatgcaacttagaaaatctagtattcttaagtgagacaaagacaaagggggaaggtacttaatttgttcataaaattattggtttgtgtgtttctttcttgacagggaaattgcaaagaagattctttggcaagttatgaattgatatgcagtttacagtccttaatcatttcggttgaacagctccaggctagttttctcttaaatccgaaagccctataatattttagggttttt

SEQ ID NO: 387527 - DNA, 3554 bp, Homo sapiens
  misc_feature (11)..(11): n is a, c, g, or t
ccgtctaggtncgaggctgggtggcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387528 - DNA, 3878 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaaaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387529 - DNA, 3877 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387530 - DNA, 3453 bp, Homo sapiens
aacggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387531 - DNA, 3362 bp, Homo sapiens
aacggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387532 - DNA, 2746 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcggggtccgctgtctgagggtcctctagagcacaccc

SEQ ID NO: 387533 - DNA, 2055 bp, Homo sapiens
ccacctgagtcacaccacctgagtccacaccacctgagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387534 - DNA, 2575 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggatacacgtcgcgaggtaccggctcgatcta

SEQ ID NO: 387535 - DNA, 2014 bp, Homo sapiens
acatgacaaaaccctatctctacaaaaaatacacaaactggtttggcgtggtggcgggcacttgtggtcccaactgctcaggaggctgaggaggaggagcctgaggtgggaggatcacttgagtccagaaggagccatgattgcaccactgcagtcagcctgggtgacagaccctgccttaaaaaaaaaaaaacccaaaacgtaacatttttggttccggttcagtctatttaaaataccatttattttcttaactgcacaaaattaggaaaataaaggaaaaaatacaattatttcttccacagaaatgcctgaatattagcagttatttatttttttgtttctgcatatattataaatattattcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387536 - DNA, 1575 bp, Homo sapiens
tgttaccaatctgaagtggaagcggccgctataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgaaaatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaatcgcagtagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaa

SEQ ID NO: 387537 - DNA, 1360 bp, Homo sapiens
aggatccccccaccggcaggttgtactccggcaggttgtacttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgaaaatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaatcgcagtagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaa

SEQ ID NO: 387538 - DNA, 3931 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387539 - DNA, 3566 bp, Homo sapiens
tctacttgggacttcgacggcccaaacaatgccgtgccactgtaaggcgttccgcaaacttccgtcgagagcggagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387540 - DNA, 4704 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgaaaatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaatcgcagtagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaa

SEQ ID NO: 387541 - DNA, 4653 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgaaaatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaatcgcagtagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaa

SEQ ID NO: 387542 - DNA, 2761 bp, Homo sapiens
cccagtcttcgtcccatcaggaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387543 - DNA, 2650 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaaggcgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaatataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatga

SEQ ID NO: 387544 - DNA, 697 bp, Homo sapiens
actcctcattggaatgtgagctccatgaggacagaaacttagttttgcttacttttgtttactgccatactcccagtatctaagctgcggtacacagtaggagctcaataaacattgtttgactcaacgaatgaattattaggtaaatagccactcccattattgttattctggcttgacaagggtctgtttcttcagaaatttagtgggtttctcttcaattaggtatctgctatgcccaaggcctctgctcagtgctgaggaaacaagcatggacaagatgtggcctccaccctgaggagctcctaaatctaggacagagtaaatctgttagaaatgtcttctctgcacataatttaagctctaccaactgttaacttcttttcatttatccaagttttgccaggtaccacaccaataaaaaaagactcagtccctcttccttcagatatctgaagctggtgatattctcctgggtcttctcttccccaggctaaacaaaaagacccagtgggattgcctgactcaggtctgccaactgggaacaaggaagacagactgtcggatagaggggcagaagagaagaggatccaggagtagagtgactccttcaaagaaaaaagagggagtccttagggaggactctgtggaattaggttggaggttgggtggggataccaggcctctgcttaattaa

SEQ ID NO: 387545 - DNA, 640 bp, Homo sapiens
cacaaaggtgaattcacttgctcaagatccaacacacacaaaatggaggtggttcaaacccaggtgtgtctgactgcagagcctgtgttcttcccagtagagatgtggatgcagcacaaatggtagaaaggacctgagacttagtcagaagacctcagttcacccaaggtatctgctatgcccaaggcctctgctcagtgctgaggaaacaagcatggacaagatgtggcctccaccctgaggagctcctaaatctaggacagagtaaatctgttagaaatgtcttctctgcacataatttaagctctaccaactgttaacttcttttcatttatccaagttttgccaggtaccacaccaataaaaaaagactcagtccctcttccttcagatatctgaagctggtgatattctcctgggtcttctcttccccaggctaaacaaaaagacccagtgggattgcctgactcaggtctgccaactgggaacaaggaagacagactgtcggatagaggggcagaagagaagaggatccaggagtagagtgactccttcaaagaaaaaagagggagtccttagggaggactctgtggaattaggttggaggttgggtggggataccaggcctctgcttaattaa

SEQ ID NO: 387546 - DNA, 618 bp, Homo sapiens
tgatgctgagtttctctctgttgcccaggctggagtgcagtcgcacgatcttggctcactgcaacctctgcctcccgggttcaagcgatttctggctaatttttgtattttcagtagagatgggctttcatcatgttggccaggctggtctcgaactccagacctcaagtgatccacctgcctcggcctcccaaagtgctaggattacaggcgtgagccactgtggctgacttctcccacccctccctttttgttcccagttctcattggtctacagtgtgagttcccaagctggaatttggaagaagcttggggctattggacataatgataataaaatagttaattgattaactataattaacatgaataatgaaatccaccattatatagcgctatctgtctggaacagtcgtgtggttggttccttttagctcttggattaaatgttgtatcttaggagagcccttcccagacctgaaattactttcttctccctcttcttcccccttatctatatcaccttatttatttatttttgagatagggtcttgctctgtctcccaggctggagtgcagtggtgccatttcagctcaccgcaccctcaacctcctggg

SEQ ID NO: 387547 - DNA, 192 bp, Homo sapiens
cctgcggctcacctcaggcagggcactgtttccctgggcccaaggaacacccagaagattcccgaacttgacacttgagctcattagcaggctcctcctcagcagcactacctgcagggagggagaccccaggggaagaggcagtgagtggacttctgggtgagtctgcatgcagtgagagaaagaatcaca

SEQ ID NO: 387548 - DNA, 311 bp, Homo sapiens
tgtaaaagaaacattttgcatcatttacttttcaccaatctgtttggcatgcctctaatgatatcagaatcacctggatcagtgtgcacatactctgcagtattttctgcacattgtgtccaattcaatattattgccactgtagtaatgaacaccacttttggccaacatggcacagtatcctattttggatttcctcaaagtggggcagttgttggtgagcataatcaatttcactttgccttgtctgatcacctttggagtttgcttgtaccccagcacatactttacactttctttgtttttgtttt

SEQ ID NO: 387549 - DNA, 736 bp, Homo sapiens
ggcgctggctcgatttgactccgagctttaccgattacttgtgtgactttgtgcaagttaattaacatctcagcttgttttctcatctgtgaaatggggatgatactagcatgtacctcctaggactatagtgaacttttaattaagataattattgaatttaacaggtagtttattaatgaaatttacataggtaattgtggcgcagtgagcccaggggctcaaggtgttagcagtcatcaacagtgctatttgaaactgtgggtggatgaagaggtgaactcaacaccacaaatatcacagagcagtaaccaccatggaaaagaaaagagagcttatgtgtctaggacaccccaagaaatctcttctgaatgaatgatggcaatgaaatagccattaacagagggtaggctggtttgtgcagggttggaggcttttccaaaaataaataactttcaaaaaatctcagccaggcgcggtggctcatgcctgtaatcccagcactttgggaggctgaggtgggtgaatcatgaggtcaggagttcaagacaagcctggccaagatggtgaaaccctgtctctacgaaaaatataaaaattagctgggcacggtggcaggagcctataatcccagctacggcaggagaatcgcttgaacccaggaggcggaggttgcagtgagctgacatagcaccgctgcaccctagcctgggcaacaaagcaagacttcgtatca

SEQ ID NO: 387550 - DNA, 241 bp, Homo sapiens
ttatataatcgcctgtgggccctatagctacataatttattatagaaattaaaatcaatgggagtaacctacataaacatacttgcacacatttatgcaatcacagagagaaatatgtgtacctgggtatgtgattacaaagttaacttttttatttcactgagctcatacctcctgctacaaatgccacacgtgattttttctctcaattaagttttacagcttataaaagcactttttt

SEQ ID NO: 387551 - DNA, 345 bp, Homo sapiens
ctgagtatgggtctgtcagcatgtggggacacttaatgtgaatgtttgatcattattttaacgtgtgccctttgtacaacttgacattgacactaccgtgaaatgtaaattacacggaactccatgggaccactaaaccctctcccactcagctacagagttagcagaatgaacgcgtgacccagttagatagctatcgcgtaacttatctgagttctctccgcttgttttcagtctccttaaccactttcaaaatcatcatgtaaaagtctgttgcacactctttccctagctgttcagactaagctccaaaagtccatagcttcggaagacgcatggacacct

SEQ ID NO: 387552 - DNA, 429 bp, Homo sapiens
cccaacacagataacagcaacaaaaaaagaaatgctcagttaatgagtctgataaaaatggtatttttgtttgctgcagtagaactttcaatggaaatttataacaagagcaattgagatgcttatacttttaacttttagccaggcgtggtacacgcgcatgcagtcctagccactcgggagggtgaggagggaaaattgcttgagcctaggagttcgagactacagtgagctgtgattgtgcccctgagtgacagagtaagacctcatttaaaaaaccaaaacaaatgaacaaaaaaaagatgcctatactttagattctagtagttctacttttgaaaatgtatcttgaggaactagtttaatacaaacatgaaaaggatacacatatatattaagttgttcatttgtggtctacttaaatagcca

SEQ ID NO: 387553 - DNA, 104 bp, Homo sapiens
taagtgccccagcgtctcagctgagctccctggtgtgagagacccaactggacagaagatgtcacacagtgggacgcgctgccaaggggagaggtctgcaactg

SEQ ID NO: 387554 - DNA, 412 bp, Homo sapiens
gaataatcaggctattgtaattatctaagtaagagaggataaggacctgaccctaagataggaagtagaaaagagggaatcttgtgggagagatggtaagatgatggaattgatagaatttggtgactgacttctgtatgtgtgtgggagtggatgctctgtgtgataacagagagatgagtttctagtcttatatgattgggtaaatggtcatactcctatttatttaaaagtacctataacatgggagtagaaagctctgaaaatgtggcatatgatctgttttaagaaaaaagaggatgaggggaaatagagagagaggaaagtgaggaatttcttttgacgactttttggacaaacttgctattttagttcactccctttttactcctagttctactaggagtaaacg

SEQ ID NO: 387555 - DNA, 209 bp, Homo sapiens
gtttgttcagtatgtttgaaagttacagggatttctgtgttttcctttttgaaatagttctgttttaaattatgtaaaatctttgaaacaataagttgtttcaaaaaaaatacactaaaacaagatacactcaaaaattcagtttccatccctttccactctacatttttccttcctctccatttttattttttgattatcctttattg

SEQ ID NO: 387556 - DNA, 289 bp, Homo sapiens
gttgtgtctcgggattcttcttttcccatattattttgttacgtctgtaaaccacctttgagtacccctcccaacactggaagaggaaacagagaccagtgcgctgtgcagtctcacttaactagaatgcacaactcctgcttttatcaccattctgggaaatccccgctgcatttcatggccagggcagcacttcatagttggaaaaggatggtgtggacttgccgcagaggccctagagaaggccatcctgtgttcctgctctccttctcatccggcttctaccccc

SEQ ID NO: 387557 - DNA, 375 bp, Homo sapiens
gaaattggccaaatatgtatgactgaatatggatccaaatctgacaggctgagttgtgcactatattaagatttgaatcctcagtttggctccttccttaggctcttgggccattgttcatccagggaagatttattgagcctgactctgagccaggcagtgtgcaaggtgtccagaggtcctaattcatttctctaggccatcattctccttggcaattagttcacaactcttctctgtcctcaacctcccagtctttcattcatccacctctctctcagctgatgagctttctgttcaattcactgagaaatagaagttaacagaagaacactttcacaggtctaccaactatatcttcacttccctaattgg

SEQ ID NO: 387558 - DNA, 339 bp, Homo sapiens
caaacacatgtgcacccacacacaaatgcatacactcacaaatgcacacactcacagagacccacacacaaatgcacatagtcacacacagacccacacacaaatgtacacacacacacggacccacacacaaatggacacactcacatatgtgtactgccacactcacatacacataaatattcacatgcatatttacccccacgcgtgtgtgcacacatgctcccccatcagcccacccggggttaagttatctctgagggagcttccacacacacctcagattcccctctcccaacttctccgatccctctgttcctcttcctttgtgaaagtccc

SEQ ID NO: 387559 - DNA, 675 bp, Homo sapiens
cagtgatgttcatcagggatattggtctaaaattctctttatttgttgtgtctctgccagactttggtatcaggatgatgctggcctcataaaatgagttatggaggattccctctttttctattgattggaatagtttcagaaggaatggtaccagctcctctttgtacctttaaattcggctgtgaatccatctggtcctggactttttttggtttgtaggctattaattattgcctcaatttcagagcctgttattggtctattcagggattcaatgtcttcctggtttagtcttgggagggtgtatgtgtccaggaatttatgcatttcttctagattttctagtttatttgcatagaggtgtttatagtattctctgatggtagtttgtatttctgtgggatcagtggtgatataccctttatcattttttattgcgtctatttaatctcctggtgtgccatttgctaagaccgttggaaaagtgcagtattaaggcaggagtgtcccacttttcctggtacagtcttcccttggctaggaaagggaaatcccctgacccgaccccttgtgcttaccaggtaaggcgatgctccactctgcttcagcttgccctccgtggctgcacccactgtccaaccagtcccagtgagatgaaccaggttcatctca

SEQ ID NO: 387560 - DNA, 270 bp, Homo sapiens
cccttccccatgccactgtctaataagtcatctgtgcacacacttaaacgcgccaggcaagctgcaacccaaagcaatttgttttcaaactaagaggacatagttcatctattgttctaaatacaggattttcttaaagtaggatatagatggtattatagtacatttttcagatgcacatatttcaccaactaaaataagtaatactccaagtttacagttttaaaaagtttttctttctttttttcttttcttttttttttttttttt

SEQ ID NO: 387561 - DNA, 535 bp, Homo sapiens
gagaaatgttcctggaaccagggtctgtttcaggaaaccaatttaaattcatgaagcttctggtatttatgataaaatgaaagtaaatctagttgaagcaaagacctacattcccaagacaactgaccattcatttattagttgctgcccctagctaacacccaaaccacaagctgccgttgctcgacctccctgcaggaaccctggtcattcagaagtaccagggtgaagctgaaaaagaagggggaacaaatagctttaaatcaagggacacaccctctacagccaaggtcaacacccaggaagggcagcagggctcggacagtggcagaaagactccacccatacagcactttgaacagaagctctcttccaactggaggcatagagctagctgctaatctgacggacgcccaaaacagagaagtgggtaaaaataaaattacgactgctcccgtgagaaggccaggaagagaacatatcgaaacaatcatggcctgcagccctgcctaacaccagtgctgctaagtgacct

SEQ ID NO: 387562 - DNA, 318 bp, Homo sapiens
cctggtacccgggcccactgtaatcaggtggcgctggttctatctcaggttggggaccttagcttttctaggctgaaagaatggagcccttctgttcagtggtgtccatctgggccctggactctggatttgacagaggccctggaggggagggccatggagttgtgcttgtgtgtcatgtgcacggtcctggtttactgtgcaccttctctaactagatccttagccaagggcttcacatacagcgtggttatgtttattaatgagtctgtcttatgaagtgacccttgtatgctgaaaattcaggtatatttgtac

SEQ ID NO: 387563 - DNA, 694 bp, Homo sapiens
ggagaactaaataaggatgtttgctattatcacatttcattattgtctattaaatgagaaagggaaagtatgaggattagaaagaaagataaaaagatcattttttgctgatggtatgattatgtacatagaatataaaaccctattaataagttactagagttagtaagagaattcagagttgctggatatgagtaacaccaaagaatagctttcctaaataatcagtgaaaaacttaattggaaaaaagatccctttcacaaaggcaataaagtaacatacataaggaataaatgaaatccaaacatttttaagatcattatctaggaacctccaaattatttttttttaagacataaaagattcagcaagtgaagaactacatcatgtccatgggtagaaagacttaaatgagaaagatgccagttcttcagttaatccacaggttcagtggatctgcagtaagaatcccaacatgatgttttgtgccacttgataagctgctcttaaaattcatatggaatggccaggcgcggcggctcatgcctgtaatcccaacactgtaggaggctgaggcaggagaattgcttgagcccaggatttcaagaccagcctggacaacattgggagaccccatctctacaaataattttttaaagtaaaaaataaatttatatggaagagccaaagacc

SEQ ID NO: 387564 - DNA, 341 bp, Homo sapiens
ctactaatcatatgttgaatattgagctagcccctattagatgccatgcacaggaataaaagaatgagaaaccttctcttctttctcatacccctcaagtggcttacaatctaccaacatggagaccacacagtaagtcctctacttaacaacttcagcaggttctcggaaactatgactttaagcaaaacaatgtataatgcaatcattttttccccccaatcaacattattaagaaacgtttttcagccaggcctggtggctcatgactgtaattctagtactttgggaggccaaggtgggaggactgctcaagcccaggagtttgaaaccagcctggg

SEQ ID NO: 387565 - DNA, 178 bp, Homo sapiens
ggaatcgagctcggtaccggtttaaagtaaatgtttttctaaataaagctttaaaatgcaacactcccttaacaaactctggtggagggaagtgaacagagaactgagactcagaggcctgggttccatcccgcccttcacggcacattgcatatggttttaaaaccacacacaactc

SEQ ID NO: 387566 - DNA, 348 bp, Homo sapiens
atggtgaatatcgttaatgataatatatttttgaaatatgctgagagtggatgttaggggttctcaccacaaaaatgacagctatgttaagtaatgcatttgttaataagctggatttaacattccacatgtatgtatacttcaacatcgtgctgtacacaataaatacatacaattttatcttttagtttctaaaaaatttaaaatgaattttaaaaagtagaattaggccgggcgtggtggctcacgcctgtaatcccaacactttgggaggccgaggcgggcagatcatgaggtcaggagatcgagaccatcctggctaacacggtgaaaccctgtctctactaa

SEQ ID NO: 387567 - DNA, 131 bp, Homo sapiens
ggcgtttgaagcccaatgtgcactctaaactgacgtgcacgaggaaagcagggcgcaggggctgtggctctggcacgaggtactttctggtctccctgccaccacttcctaggtacagctgtaacaccttg

SEQ ID NO: 387568 - DNA, 481 bp, Homo sapiens
gtagagacggggtttctccatgttggtcaggctggtctcgaactcctgaactccaggtgatctgcccaccttggcctcccaaagtgctggaattacaggcatgagccaccgtgcctggccccagtatcatatttctaactacattaggacatctctatctaacatatctgaggacatctctatctagcatatttgaaaccaaattatagcctggaatctgaaatggattagaaagcacttattactgggaaatatctcaaactccaagggtaggaagtacagctgggtaccataaagacttaagtcaagaactggaaagtcaggaaacacaatccctgtatcagctttgatttaatcagagaatttggactattaatattatgaaataaggaatacatgagagaaataaaaccttatgtaattgtggcaggatctgaggaagtaaagatccaaaatgcatcagagaaaattcactgacaag

SEQ ID NO: 387569 - DNA, 169 bp, Homo sapiens
ctcgtgatctgcccacctcggcctcccaaagtgctgggattacaggcgtgagccaatgtgactggccaattctttatcatatatgtaattaaataaaatttattactaaaataatttccccaaaggtgttttacttttttaaaaacagtggctacaaaaaaattttgag

SEQ ID NO: 387570 - DNA, 213 bp, Homo sapiens
aacagagctgatactctaatgaggttaataaatgggtcgtgaataagtgacacgcaatgtgcatccatttatcatttattcattgactgcattcagtgtgtcaacaccatgtcacaggggctggagtggagaaaacgtaggggaagcagtggaggctggaaggagagagtggtcattggagggtccaagaatgcctaatagcatcttgagttg

SEQ ID NO: 387571 - DNA, 198 bp, Homo sapiens
ttgcatcttagtgacttatgttggagggacacaagaaaaaagttgttgaatgaatgcttcatgcttaatacaaacacttctaatggctcattgattataatgtattatcacattttattttatcctcagacatgattgactttctaaaggcttgaatcaaatattgatcgactataatgtgtattatcaccactcttt

SEQ ID NO: 387572 - DNA, 379 bp, Homo sapiens
ttgttaacagcttgtcttctccctgctggcttcgttcaaggccattcattcatttagttcattcatttagtcaagtcacctaacacttactgataggtgttatagtccagggcttgggctaggtgctctcacatttaattacctgatttaatcctgacaataactgttgaacaactttgattatccccattttacagatgaggatattaaaaccagaaaggtgaagtgattttccagggttccacactaaagagtggcagagccagagcccacattgaaacccaatgtagttctgtgttggatccagagaatagttcctgagggtccctgacaagtgtctcatggcaagtatggacctactgtaagattacccagggta

SEQ ID NO: 387573 - DNA, 354 bp, Homo sapiens
caaggcaattagtgctcccacaagcattcaatggagtgtttcttttattccataacttcacaaacacttggtatattcaactctaacatttttgccaatcttgtgggtatgaactggttttaatttttatcttgttactgatgaaacgtttcatatacttttggactatatattttgttttcagtgaaacgcctgctttgtcttttgcctgtttttaattctatatttgtttgacttttatatttttttcttgaaattctttatagtgtttatagtgttccagtcttctgttactccttcaagtctgtggttgttttttcacttcctttctggtatgtgtggtaaccatgggag

SEQ ID NO: 387574 - DNA, 440 bp, Homo sapiens
gtctgttagcctctctgaggcttcaaaggttcctcatctgtaaaatggtaataatcataccattgctacagggctgttttgaagactaattaggactatgtaagtaaacatgatgatggctattattactgttccccgccaggggccatgcaagggttgctgattcacatagactgtcttataatcctctcaataactccaagaggtagccagcacctcagatatacataaaatgacttaagcccagagaggtgaagtaagttgcccacagccacacaactagtaaatagcccaaacaagctggattcccagttagactccgttaatagcactgctctttaccttaagtcattacaatgcctaatatgaaatagaatcgcttctttcttagggttcaagtggttaattatttaatgtattcattcaacaaaccatcatcg

SEQ ID NO: 387575 - DNA, 289 bp, Homo sapiens
ccacttcctggattcaagcaatcctcccacctcaggcccccaagtagctgggactataggcgtgtaccatcacgcccaactaatttttgtattttttgtagagatgagatctcgccatgttgcccaggctggtctcaaacccctaggctcaagcagtctgcccaccttggtctcccaaagtgctgggactacaggcatgagccaccatgcccggccagctttagtgtttgaggatagctattgctggacagctatcctagacagcccacagtcatctcaagttctgcgt

SEQ ID NO: 387576 - DNA, 966 bp, Homo sapiens
aaatgttgatgaattgctaatacctggatttcccaggagtgtaactaacattatctgggaagaatgaatctgaatcagcttctccttggaatccagcatcctagtcccagcgcttgggaatactacttttccagccatggtctttcttgagttgctgttaccagtgaaaccttgggctgcccccaggtgtgtttagcccagaggagaggactttcttgccctttctttccatcttttagctccttatcatatactggttcagttgtacccttttaccttacccatttctactatcatggaggttcagaattcacatctgaattcaaaagataattgggagccaggcatggtggtgtgtgcttaataatcccagttacccaggaggctgaggcaggcagcagaggatcacttgagcccaggagtttggaggctacagtaaacttcagttgtgttattgcattccaacctgggcaacagagcaaggccctgtttctaaaaaaaataataggccgggcacagtgtctcacacctgtaatcccagcacttcggaaggccaaggcgggcggatcgtgaggtcaagagattgagaccatcctggcgaacatggtaaaaccccgtctctactaaaaatacaaaacaaaaaaaaaaaaaaaaaaaaaaatgggggggggcggggccaggaaaacgttttaaacccatcgtttggggggcgggccacggtgggacatgcaaccgggccacaaggtgtggcaagagaaaccgggcatgacagggcgcgggttcccaccaataaaaaagcgcgcgggacaccgaccgtttggcacatcccgtggggccgggggctaccggtccacacagggtccaggacccgattcccgccccagcggggagaaggaggacaagggcaaacgacccacaggaagcgcgaggtcgcgacaccacagcacacacgccgccggcacacaa

SEQ ID NO: 387577 - DNA, 805 bp, Homo sapiens
aaatgttgatgaattgctaatacctggatttcccaggagtgtaactaacattatctgggaagaatgaatctgaatcagcttctccttggaatccagcatcctagtcccagcgcttgggaatactacttttccagccatggtctttcttgagttgctgttaccagtgaaaccttgggctgcccccaggtgtgtttagcccagaggagaggactttcttgccctttctttccatcttttagctccttatcatatactggttcagttgtacccttttaccttacccatttctactatcatggaggttcagaattcacatctgaattcaaaagataattgggagccaggcatggtggtgtgtgcttaataatcccagttacccaggaggctgaggcaggcagcagaggatcacttgagcccaggagtttggaggctacagtaaacttcagttgtgttattgcattccaacctgggcaacagagcaaggccctgtttctaaaaaaaataataggccgggcacagtgtctcacacctgtaatcccagcacttcggaaggccaaggcgggcggatcgtgaggtcaagagattgagaccatcctggcgaacatggtaaaaccccgtctctactaaaaatacaaaacaaaaaattagctgggcgtggtggtgtgtgcctgtagtcccacctacttgggaggctgaggcaggagaatagcttgaacctgggaggtggaggtttcagtaagctgagattgcgcccctgcactccagcttggtgatagagctagactctgtctccaaaaaaaaaaaa

SEQ ID NO: 387578 - DNA, 3063 bp, Homo sapiens
atgatggagacgccgctccccaaagcaccagagaaaaggcaagtgaccgccattattttcttattactactgtgggaggcgggcagcgctacgattaagtattcagttctagaagagagggacagcggctcttttgtggccaacttagcaaaagatctggggctgggtgtaggggaactggccgcgagaggcgcccggattctttccaaagggaacaaacagtatttgcagctcgaacggaagagtgggaatttgctcctaaaagaaaaattggaccgggaagagttgtgcggtgacatagatccatgtatactacatttccagatgttactgaaaaatccggtgcagtttattcaaggtgaactacagctccaagatgtaaatgaccatgccccagaattcttggaaaatgaaatcctcctgaaaatctccgaaggcagccatccagggacttcatttcctttgaaaatagctcaagatttggacgtaggtagcaacacagttcagaactactcaattagcaccaactcctatttccaccttttcactcgcaatcacagcgacggcaagaaatacccagagctcgtgctggatcaagcgctggaccgcgaggagcagccccagctcaggttaaccctcacagcgctggatggtgggtcaccgcccagaactgggacttcccaggttctcatagtgattgtagatatcaatgacaacgtccctgaatttgctcagcggcgctacgaggtgcaggtcccagagaacacccctataggttcccttgtcatcaccgtctctgccagggatttagatgctgggacccacggggagctctcctattcattttttcaatactccaatcaaatcattcaggcctttgaaataaactcaatcacgggagaaattagatttaaaaaggcgttggattttgaggaaattcaatcttatcacatggaagttgaggcctcagacggtgggggtctttcaggaaaatgcaccgtagccatagaggtaatggatataaacgacaacgcaccggaacttactatgtccttacttatcagtgatatcctagaaaactccccagaaacagtggtcgctgttttcggaatttcggatccggactccgggaacaatggaaaaatgatgtgttccatccaagaccatctccctttccttctaaaacctaccttagaaaatttctacactttgttaacagaaggagcgctagacagagagagcagggccgagtacaacatcaccattactgtcacagacttggggacacccaggctgaaaaccgagtacaacataaccctgcgggtctccgacgtcaatgacaacgcccccgccttcacccaaacctcctacaccctgttcgtccgcgagaacaacagccccgccctgcacatcggcagtgtcagcgccacagacagagactcaggcaccaacgctcaggtcacctactcgctgctgccgccccagaacccgcacctgcccctcgcctccctggtctccatcaacacagacaacggccacctgtttgccctcaggtcgctggactacgaggccctgcaggagttcgagttccgcgtgggcgcctcagaccgcggttctccggctttgagcagcgaggcgctggtgcgcgtgctggtgtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctccctgaggcggccccggcccaggcccaggccgactcgctcaccgtctacctggtggtggcgttggcttcggtgtcttcgctcttcctcttctcggtgctcctgttcgtggcggtgcggctgtgcagaaggagcagggcggcctcggtgggtcgctactcggtgcccgagggcccctttccagggcatctggtggacgtgagtggcaccaggaccctgtcccagaattatcagtatgaagtttacctggcagaaagctctgagagccagttaaagtttcttaaaccggtacttcccaacttcttgggtgaagggactggtggggacagcgaggcaaactccaactctaggaatcattttgggttcaattaggaatctgacaacaggtcgtgataaatcatagaattcactattcatctgtaagttcccaattctctcattcgcgtagagtcacatattcacacattagtaatggctgtcatatttatagctatttcaacctgctggactattttccattccctttaatttttgttgtggtggttgtcagctatgttagttacagcatgtgcacacaatagcagagaaatggtgtttcctatggttgttgtttttgtttggtcagattttggaactcacaggtgttttcaggttcccagtatttgaacttgttcattgatatgttatgattaagagaatagtgtttcaaactttctggttatcatcagcatgactctaagtctatcgtaaatcacagcttttagcctaaaaaataattttcatttatgcaaaaattttagtaatcttgtaaattgttgcacttctgttgtgttgtttcaaaaacactactcttccctcaaatgaaccaatattttacctaggtgatgttttctctcctgaatttcttttttcaaaattgatatttatagaccatcggctgttattctaaaggattcaactcctgttacatgaaagaataatagaaaaaaggttggttgacttgtgattgctttttttttaataataaatggctttggtatgt

SEQ ID NO: 387579 - DNA, 332 bp, Homo sapiens
attgatcaaagcactgtgcatggcttaggagaaccgtggaccaagcaggcccgtatagatgatccaccctgtctgatggtgattaccagcatctgacagatcaagaggatgtgggaatgagggtttgaatgaatgcagatattcatcgcttgagcccaggagttccagaccagcctgggcaacattagtaagactgtgtctctacaaaaataaagtaaattagctgggcaaggtggcacatgcctatagtcccagctacttgggaggctgaggcaaaaggatcacttgagcccatgagttcaaggctgtagtgagctatgattatactgcac

SEQ ID NO: 387580 - DNA, 960 bp, Homo sapiens
aaaactccaagcaaagaaagaatgaagcaacaaaagaacaaaagcagggatttattgaaaacaaaagtacactccacagtgtgggagctgccctagcagcactcccccccgacccccgctgctttaccgaatcttcttgggtccaaataccccctagaactttcccattggccattccatgctcacctcatgtaaatgaagaggtggcttgcaattggtctgattggttgccagacccacccccacatcagtccgcttggttgtggacagcgaccattcagtggctagagtgaagttacaaagttgcaaacgaagattccacccgcagtcagtctgatttgttgaggacagccaatttcccgtctactgtgcagaaaaggtaggtggtttgcaacgggagtagcctctggtccttttgttacttaggcgtggaaagttagggttttcccttcaagttagttctgggaagtcggggtgaaacagccttagattccctgcctccagaccctattcacctgcctcactagcacctccagtgttttcatccagaagctcaacaaatcttattcaacggtttttatagaacttcatctccatcccctcccatagaggtgtgtgtgtgtgtgaggctgagagttcaaccctcttgtcacatggtctttctggtgactggccccaccctaaatcacttcattagcataatcaggtttgatcaaaaatagtggctcataaataaccaaagacactcctattagaaaattccaagagttttaggaggactgtgacaggaactggagagaaagaccatgtatttcatattatatcacagggacagaggtaatggttaaagctagtggataatgatgcaagtattgtctgctgaaagccaattcgttccgtatttcttaatattgcatgtttggtatcttttggttgcaagcaacaaaaacgaatttaaga

SEQ ID NO: 387581 - DNA, 569 bp, Homo sapiens
ccctgctatgcaaaacctttcccagaccttggtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgaattataaaattattctgcatctcatcacatcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattggatt

SEQ ID NO: 387582 - DNA, 430 bp, Homo sapiens
atgttggcgtttccgctgtattttcttgcagtgtgccattctgttagacattagcgttttcgttgatgagcaagacatgcttaatgcatatttcgggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgtcctggtcaagcccccctcactctgtttcctgttcagcatgtactcccctcatccgattccgttgtatcagtcactgacagttaataaacctttgcaaacgttccccagtt

SEQ ID NO: 387583 - DNA, 284 bp, Homo sapiens
  misc_feature (92)..(93): n is a, c, g, or t
  misc_feature (99)..(99): n is a, c, g, or t
gagctcggtacgggatctctagagtgacctgaggatgaatgatgacatggcgtcgtatacaacgtcgttgatgtgagcaaacaaaagacaannagaganatgggttatacttattcttgcttactgccctgggtaaggtcagggtataacaaagtaagaagtaactagagaaagctatggattattttacaccaggaagggcttgcagtgcaagtcctgactcttgtcaccactcatttctacatcctactccagcctcagaatcttatggagaaaccactctc

SEQ ID NO: 387584 - DNA, 395 bp, Homo sapiens
aatatttcattccttcctttctttcttctactcttttttcttatctacctctacttctgttcctccctctctctccttctttcttttttccttccattctttagtaaatattcatcaagtacccactcattcctagagactgtgttaacagtaataatacgacactaaatgggctttgttcatagaactagagtctactgcctagcattttgtcagacttcattagctggtagaaatagactactattcaaatgtctatgtcatagagtctcctcccgatcaaatgcagaaagaaaaatcctttcaattcttttaatgattgttgggtaggcagaaatattgtaggagatgggtgtacagacaaacaactctgaatctgaaagtattacacatat

SEQ ID NO: 387585 - DNA, 847 bp, Homo sapiens
aacagagcaagactctgtccccacccccaaaaaagtgaagaacccaatttaaaaatcagcagaagatctgaacagccatattaccaaagaagataaacagatgggaaaaaaaagcacaagaaaagatgctctgcttcacatgtcatcagaaaactacaaattgaaacaatgagatacctctacacacctattagaatggccaaaatccagaatcctgacaacaccaatgctgtggagcaataggaactcttcaatcatggctggtaggaatgcaaaatggtatagccattttgcaacacagtttgacagcttcttacaaaactaaatatactcttgtcatacagtccagcaattgcaatccttagtatttacccaaatgagttgaaaacttatgtccacacaaaaatctgcacatggatgtttatagcaactttattcataattgccaaaacttggaagcaaccaaccaagatgtccttcaataagtgaatggataaataaactgtgggacatccagacaatggaatatttacagtgctaaaaagaaaagagctatcaagccatgagaaggcatggaggaaacttagatacatatttattatagccttttcagatgtatagttatatctgtataattccagctatataacatggaaaaggtaaaactgtgcagacaataaaaaggttggtgattgctagaggttgctaagaggagtgggaattaataggaagggcacagaggatttttagggcagtgaaactattctacatgatactctaatcgtgaatacaagtcattatacacgtgtcaaaacccatagaatgtacaataccaagagtgaaccct

SEQ ID NO: 387586 - DNA, 1477 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387587 - DNA, 1065 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387588 - DNA, 968 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387589 - DNA, 1313 bp, Homo sapiens
tgaaataatattggatgtgattatctttattaaaaactaaaaattattgcaaaataatttgacagtgaatacaaatcaaaatttcaaatacaggcaggctgtgcttaccactctcatgcctcagtgacctcaggagttgtcccttcctcctccctcccattcttgccctttgtttctgggaagggggattagggtacccaagttggggccttataggaagtgggaggagaagagacccagttcttggagttggatcaccaaaacaattccaatccatcctcaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387590 - DNA, 1963 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccccagcaccacggcaccagcctcacctgtcaggtgaccttgcctggggccggcgtgaccacgaacaggaccatccaactcaatgtgtcctgtctccatgtctttctgtcccagaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387591 - DNA, 1756 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387592 - DNA, 1864 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtgtttgtctctctgtgcctggcttatttcactcaacataacatcctctaagttcatctgtgttgtttccaatgacagagtaatgtactgaataattcaaaatagctaaaa

SEQ ID NO: 387593 - DNA, 2128 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387594 - DNA, 1021 bp, Homo sapiens
ccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatatagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 387595 - DNA, 420 bp, Homo sapiens
acacacacacgcacacacacacactggattcctcttgaatatcattttgtaatctgctcttattgaagtcgaatttagacacagtaaaatgaactctctttggtaaacagtgccatgagtttgacaaatgcatacagttgaatcattgctcctatggtctgtagtcttatcctatatactttgctgtacattataaacatatttctgtgtcactaaaggtagatctcttttttttgttttgttttgtttgttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcac

SEQ ID NO: 387596 - DNA, 3277 bp, Homo sapiens
  misc_feature (69)..(69): n is a, c, g, or t
  misc_feature (723)..(723): n is a, c, g, or t
  misc_feature (881)..(881): n is a, c, g, or t
  misc_feature (961)..(961): n is a, c, g, or t
  misc_feature (1120)..(1120): n is a, c, g, or t
  misc_feature (1700)..(1700): n is a, c, g, or t
  misc_feature (1950)..(1950): n is a, c, g, or t
  misc_feature (2283)..(2283): n is a, c, g, or t
  misc_feature (2320)..(2320): n is a, c, g, or t
atcgtattttaaacttgagttcagacttagaccttatgagttgaaggtgatttcctgccttactgagtntttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaaganagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagantgagaaagggaaagagtggtgaagtggcataggcgataacatccttatctctcatcagtcacacattagtaccttaactntggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctnttgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatnattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcnaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattattnaaaaaagaggacacgtgctattaagttccaaattacnggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgattttttaccaggaaatctgtcaacataatttattctatcaaagggacaaataatcatagaagctattctcatgagaatttgaagtaaaatgggtataagaaggcagttatgcgtgtaatcccagcactttgggagggcgaggcagttggattgcttgagcctggtaggtggagtttgcaatgagccaagactgtgtcactgtacttgagcctgggcaacagaatgagactcagtctcaaaagaaaag

SEQ ID NO: 387597 - DNA, 284 bp, Homo sapiens
tggcctcggggttggagacccctgctgtaatccatagtgtctgtgacctccgttgtcagggtagcagttgtgcatgagtaaacagcaaaagtgcccacatcaaaagaatggatgtcactggtttcaaagaaaattataaaagtaatggcactcccttaggagctaggaataaaatgattatggtgaaaaaattggtaaagaaatgaatcacatatgttcagtcacattcccaaaacagaagtcaaaactaggtcagctcttactctttaaagttgataagaaaa

SEQ ID NO: 387598 - DNA, 112 bp, Homo sapiens
catacaattctctacacacgttagaagtttcaagcggctttacaacatcagttttgctaaatccggcaatcctatagtgtcattggctgagtattcctgagcacgtcttaca

SEQ ID NO: 387599 - DNA, 292 bp, Homo sapiens
ccgtatactggctaatgaactacaatattaaaataattatttctgcaagcaagttgaaaaccaagaaaacaatatttgtttcataaatgtatggcatagatttccctgtttattattctttttatctgcaatagagaaatttcagtttctggaatatgttggtactgctaagctaaatggcaaataacatagagttcaatgtcattctttattgcatttacatttggtgatacgttatattgaacttttcttgcattaaaaagatagtatttttcccctctctcacaaggca

SEQ ID NO: 387600 - DNA, 231 bp, Homo sapiens
aagtgttctttgcagatacatgcacattttccttttttatccgaatggaattgtgtatagaattgtgattctttcttaattcagatttattagtatattgacacatatggattgacctgggtttttgttgttattgttttgggggattttgttgttgttgttgttgttgtttgttttttgttttttgttttttgttttacgacagagtctcactcagtcacccaggcttga

SEQ ID NO: 387601 - DNA, 231 bp, Homo sapiens
ggaacttcatgaaggaaaggaaagcaacaaaaataataaatatctggataaatataataaattgttttttctcctcttaagttcattaagatatgtataatggtagaaataaaaagttaacaatattgtctgttggggtttccaatgtgtataggtcggaaacaactaataatatgaaggagaagactttaaagagaaccaaatgtctgtaaggtttataagttacccatg

SEQ ID NO: 387602 - DNA, 294 bp, Homo sapiens
ttattttgccctgaaagcagatgatggtgttaaataaagcaacaaattaaatgtggatgttagtgctgcaatggaggaaaacttgcagaaaaattgacctgacttatttaatcaagtgcagagacattactgtgctacctggggagctattcaaatacaatacaatctatatgccttccacctgagcaaccaagttcttacagcgctaactagagaaggtgcaggggagggggggaggactggataaagttatttttgtggcagttaagcttcgattacttgtagatccataaa

SEQ ID NO: 387603 - DNA, 379 bp, Homo sapiens
taaactcattcatcgtttcttgaaataaacccaataaactttaatggaagctcataagaatttttttctgaattctgccctctgtcaaaggaagaaaatgacaacatggacgcatatctgtatttgggtggcattaatgactcagtgaccttcacttttgcagccagcgaaatacttggcaattttaatttagaaatattactgtatcatcatttaacagaaatacttactaaagcagaaatatactgactttagaagcatttcaaagaagcagggttggcactgaccagtgttctcttaaggtagaagacagaatatttgactaaagacagtgctgtagcaggtagaaatagacattatttagaccccttttctgagt

SEQ ID NO: 387604 - DNA, 401 bp, Homo sapiens
ctccagttgccaaatacatgttcctcattttattctaagccctcaccaaccagaggcacttcttttgtttgtttgtttgttttttggagacaaggtctggctctgtcactcaggctggagtgcagtggcaccatcttggctcactgcaaccttcacctcccgtgcttaagccagtctcccacctcaggctccagagtagctggaactacaggcacacaccaccacacccagcgtgtgtgtgtcagcgtgtgtgtgtgtgcatgcgtgcgtgtgtgcgtgtagagatgggttttcgccatactgcccaggctggcttgaactcctgagcccaagtgatctacctaccttggcctcccaaagtgctaggattacaaatgtgagccactaagcctggccttttt

SEQ ID NO: 387605 - DNA, 123 bp, Homo sapiens
caagaggtaagggttaacatggggctggaacctgaagaatgtgatttagcatttcccaaagtctgttgtgtggacattaagtccaataacatgctcagagcaaaacacagttaagtttcagga

SEQ ID NO: 387606 - DNA, 222 bp, Homo sapiens
ttctagatgtcaaagtaagtataaatgggcatagacatgattaggttaggctgaaaggttggttggtcattgtttacagttggtggtagaacatgccaagttagatgagtcccaaagagattttatagctatgagatatcatcttgtgtgttcctggctttcagattggtacttgtcaccatggaattctagagcagcaaggaagtgcagatcttattattt

SEQ ID NO: 387607 - DNA, 112 bp, Homo sapiens
tcgcctggcatttgagggctcaaaacctgttgtttggatgaatgctggcctttgtggcaatattccctcccaacaatagagacttctgttgcgtttgttgtgttcaagtgtc

SEQ ID NO: 387608 - DNA, 421 bp, Homo sapiens
ttctttcttttgttccttccttctcagcctcctttcctaactttctttccccaaacatcaagtgttgagagagttctttggttataaacatcctgggtcctcttcacgtctcactctattctttctcaaagggatctaatctactcccatgattttaataagcacctagaagatagaattcccaaatgtttgtttctaattcagatccgaatacacacctgctaactcaacatcacatggatgtctcagaggagcctaaatttcactcatcatgactaaaaactcaacttaccatcattgtcatccaacataaatgtggcctatatcagtaggtggttcaacaaccacccagttatgcaacctgaaatccagagggacattcccgaaaccttctcctactaactttccagtatgtaaccca

SEQ ID NO: 387609 - DNA, 390 bp, Homo sapiens
gcatttatgactaaaagctttagtgtgacctagatcaagagtaggaaaactttttctgtcaagagcaagatagtaactatttttgtctttgttagccatatggtccctgtcgcaattactcaactttgccactgtagtgagaaagccaccagagacaatacataagcaaggggagctagctatgttccaatagaactttatttataaaaacaaatggtcaactatagtttgccagcctctgatacagactcttcatacttcatagtccagtctcccaacacttcctcatcttaccttgatttctactaaatgaaactttgacttcaggattcagatctgatgtcacttccataacacatctttcttggaatgtactgcatcattcctgga

SEQ ID NO: 387610 - DNA, 513 bp, Homo sapiens
ttgcagtgagccaagatcatgccactgtactccagcctgggcaacggagcgagactccatctgaaaaaacaaaacagaaaaaatcttgaaaggatactaagtctgacacaaggaaattaagtcatgggactctgaccagatattctgtctacttccttctctgctatgggcaacttggaggcagcaactactatcagtttatctgtaatgtgagaatttatattacataacagatactggggatataggataccatggattttagttaatacatttcctcatagaaaataaggaaataacagtcttgttcctgtcctaacaattctgttagactaatgatctccagtgattggcgatttgacctggtttcttcctggactatttgaatgggtggatttgttggtgcatctcttgtcttctttccttttccattctcctttatttttgtatttacatacttgtatgcaactttgtaatctgattttcccatgtaacattttaatttgatgggtg

SEQ ID NO: 387611 - DNA, 618 bp, Homo sapiens
  misc_feature (598)..(599): n is a, c, g, or t
  misc_feature (606)..(606): n is a, c, g, or t
ttgcagtgagccaagatcatgccactgtactccagcctgggcaacggagcgagactccatctgaaaaaacaaaacagaaaaaatcttgaaaggatactaagtctgacacaaggaaattaagtcatgggactctgaccagatattctgtctacttccttctctgctatgggcaacttggaggcagcaactactatcagtttatctgtaatgtgagaatttatattacataacagatactggggatataggataccatggattttagttaatacatttcctcatagaaaataaggaaataacagtcttgttcctgtcctaacaattctgttagactaatgatctccagtgattggcgatttgacctggtttcttcctggactatttgaatgggtggatttgttggtgcatctcttgtcttctttccttttccaaaaggataagctcttctcttaggttggctttaagtgacaagggctcgctgtcacccagcctggactaaactcttgggctcaagtgatccgcccatctcagcctcccaagttctgggattatagacatgagccaccacacccagcctatcttgttttcttttttactnnttacagncagtcaaggtct

SEQ ID NO: 387612 - DNA, 551 bp, Homo sapiens
aggtccatcaggctgtaccatgtggcagatggagcccatggaggatggaggcccctggcacactgactgtccccactcatcccctgggtagggcagaagtgttcccacaccgtacagcctgccagtgggcatcagggaaacacctgagtcaccacgaggagtacgaggcacttgggggttgcccagctgaccaggagcacagagggctgccctgaaagtgagcccctccctactcctagcagagacggggaagggagacaactggacttggtgggaaggactgggccccaggtggcttagttgctctggccccagaccaggtctctctagagctctgggccatttgggttaagcttctaactaccactgcccatgaaattcacctgccaatgggcaatggatggagtcatgcccctccctgcacctaagttctctgaagggctgagtttcttcttggggccagacagtgggtattggaatgggagcatgggggctgcatgtgcactgcaggctttgtgtgtgtgtgtgtgtgtgtgtgtgtgtgtgtgtgt

SEQ ID NO: 387613 - DNA, 692 bp, Homo sapiens
tcttttttctatctcatttagtgcctgtccattccaaggcagcataaagttagcatagcttctcattttactggtttggtaaaagttttaaaggtttagttcagtttgcttttgggttttcatatgaggtagactatgagaactctttaatttatgatgtgatatataattaaagacaatcccattgtagctggcatgtgggctattactggggatcatgggaaagagaaggcttggaggatcttctttataaaatacacgtaagtatggactgaattccaaacaaaccgcaaaatggaaggaacctcgttttatcgcatccaggtaaaggatagaaaaggtatcttcagttttcccagaagcaacatccacaaggacaactcgtaattttaaatgattaaaagtaattgcagtagatcagtgtcattcatagcaaattagttctgattgatggagaatgctgcatctgtggatttttatgttataaaattaatttaagacttcttttgttaaactcgtttaatcttctgcactactccgttctttcattatccttgtcagttttaagggctggaatatctttgtacaactaaattcagttgacttcttctggatacccaagttgaacagacacatatattagtggagctctggttggaaagaggacaccagtacacactattagtagccta

SEQ ID NO: 387614 - DNA, 622 bp, Homo sapiens
caaaattgtcatttataacaatttcccactgtataaaaatacagtttcttgaggaaagggccaccttctcctattctgcaggatttaggtgaaatatgacaacagtggccctggtcttactgagaccaacaaccattttctgcaggatgagtctacttctagcccagtaaatccatctctccaatctcattctgttcatcaaaagaaattcttttcgagagacctggctagatgttcggttgaagactgacaccccagggcagatggaactgtcagagttcaagttaaactctcctatacttctgagttgagagttgtgagtctggatgtgcctctggtgatgtgaaaacactcaacaccattggcaagcatacacctggtggttaccaggcaccttgagatgccagggtgtccagccttctggagctggctttggaagaaaaatgtatccaactgggaaaccgacatgtacactccaagggcataaaccaaggaggaggaagagttggaatccgggaaacagaagatccaacactagacagagacagggaagtccaaggaccagcgctatgcagcagagcaagagagtgagccattccgagaggagctggaggggtggcct

SEQ ID NO: 387615 - DNA, 171 bp, Homo sapiens
acagcgtcagcttcccaaagtgctgggattacaggcatgagccaccacgtccacccctacattttttttctccccccagatgtatacttttaagttctgtttttgtttttgtttgtttgtttgtttgagtctcactctgtcgcccaggctggagtgtggtggcacaatctt

SEQ ID NO: 387616 - DNA, 308 bp, Homo sapiens
ttttttggtcatgaaagcaatccagctgcccctgggtgctgtaatgatttcaactaactctgctaatcaattttatattagtcaaaacggagcatatatctttcaggtcaagagtttatttatttatttatttgtttattttttgagaagaagttttgctcttgtcccccaggctggagtgcaaaggtgtgatctcggctcactgcaacctccacctcccgggttcaagcgattctcctgtctcagcctccagagtagctgggattacaggtgcctgccaccacacccagctaatttttgtattttta

SEQ ID NO: 387617 - DNA, 411 bp, Homo sapiens
tgcttcctcattgcaaaaccagcattcctctcacggtcagctatgcacaaaatatccttctgttctcctggtcacatcaaagcaccttcacgctatgcagacaggtcattgagggaacggagaaaattaacaaacgcacctaggttatttctattaaaattagcccctcagccggtaggctctgtcagtttccattgaacacaaactctgacaagtctgttgaaaacttttaacctttccaggttgtgtcaacagcttgcaaacacaacaggaggatggtgcctctgagttctgcctttccttttggaatagaggaggtatcagaatttgttaccaccagctttcatgtttatcttcactgctctgctcactccccgctgccacttaaggagcatacaaacaccttactgg

SEQ ID NO: 387618 - DNA, 3637 bp, Homo sapiens
  misc_feature (2099)..(2099): n is a, c, g, or t
cccctgtctccctctctgaacccgcccattgggggtaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387619 - DNA, 4175 bp, Homo sapiens
  misc_feature (2637)..(2637): n is a, c, g, or t
aggccgggaataatacgtttgtgcagcaaaatggttatgtgaccgattttttaaaacacagaattctgccccactgaatacatacacataccacaagtaaaatgaaatatacttttaagtgcccgttttggtgccactggccaaaattaaaactctccttccgtatgtgaggtgacttgagatttcttttttgctttaaatgcctgccttcagggtacgtgaaagtgggagaccggttggaaaactggggctaagggggctgggagcgagatggctgtgactgaatcaggaagctggatgtgagagagaaaaatcctcctccagcctcggagggggtgtctcccctaataccagctccctccccccgggctcgtggggcgggtctggtttgctcagtagcggcagcggccgcagcagcagccccggggctgagcagcggtggcctcctggcagcgcagggaagcggcggctccaagagcgcgaggccctggggagatccggccaagactgctgccgggatggaggaagcgtccagtggagcaggagtcaccggggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387620 - DNA, 3312 bp, Homo sapiens
  misc_feature (17)..(17): n is a, c, g, or t
  misc_feature (1774)..(1774): n is a, c, g, or t
tctagaggatcccggcnacatcctgagatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387621 - DNA, 4838 bp, Homo sapiens
  misc_feature (3300)..(3300): n is a, c, g, or t
aggccgggaataatacgtttgtgcagcaaaatggttatgtgaccgattttttaaaacacagaattctgccccactgaatacatacacataccacaagtaaaatgaaatatacttttaagtgcccgttttggtgccactggccaaaattaaaactctccttccgtatgtgaggtgacttgagatttcttttttgctttaaatgcctgccttcagggtacgtgaaagtgggagaccggttggaaaactggggctaagggggctgggagcgagatggctgtgactgaatcaggaagctggatgtgagagagaaaaatcctcctccagcctcggagggggtgtctcccctaataccagctccctccccccgggctcgtggggcgggtctggtttgctcagtagcggcagcggccgcagcagcagccccggggctgagcagcggtggcctcctggcagcgcagggaagcggcggctccaagagcgcgaggccctggggagatccggccaagactgctgccgggatggaggaagcgtccagtggagcaggagtcaccggggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387622 - DNA, 3430 bp, Homo sapiens
  misc_feature (17)..(17): n is a, c, g, or t
  misc_feature (1892)..(1892): n is a, c, g, or t
tctagaggatcccggcnacatcctgaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387623 - DNA, 3448 bp, Homo sapiens
  misc_feature (34)..(34): n is a, c, g, or t
  misc_feature (1910)..(1910): n is a, c, g, or t
cgcggtgactgggcatagctgttctagagtaccnggtattcgtgactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaanattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttg

SEQ ID NO: 387624 - DNA, 301 bp, Homo sapiens
caggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctg

SEQ ID NO: 387625 - DNA, 292 bp, Homo sapiens
agcggaaaatggaaccaagatttttatagccacaaaactgactttcgactatgaagtgcaagaacttcctggtgtggactgaatatgccgtcccaaaattcatatgatgaaatcgtaacgcccaaggtgacagtaccaggaggtgacgcctttggaaggtgattaggtcatgagggtgcagcccttatgaatggcattagggcccttataagggagattccagatagctccctttccttctgccacatgaagtcttagtgagaagatgctgccagcaggccttcaccagatc

SEQ ID NO: 387626 - DNA, 406 bp, Homo sapiens
ccaggactgggcactaatcacagaactgtaacaggcaccccatgggaatgaccaactgttagacgggggctgcagggcagcacttccctcttgcctcccaccaacagcttctaaagggaaatgtcgactgttttcacaccagtcccctcactgcggctgtttgtgggctcagatgataggtcacaacaacctgattcagtcctcactgtggctgtgtgggggggggtcagatgacaggccaccacaacctgattcagtccccactgtggctgtgtgtggggggggggcagatgacaggccaccacaacctgattcagtcctcactgcagctgagtgtgtgtgggtgcagaagacaggccaccacaacctgattcaggattcagttgggctaccagccagtgccata

SEQ ID NO: 387627 - DNA, 600 bp, Homo sapiens
ctcaagttcccagtgactttccggaggccgggaacagggaaaactttttccaatacagtcagatcccgcctccccggaggctccatgtcctccacagctttcccaggaccccagagtccaggcccctattcccctcctcccgccgaccatagcagacaaagaccccagccaagcccagtggcgctgcggcgttcaggacccccgtaggccaaaatcccagcccagcccttccccatgtggccagacaaagggacggtggagccgggtaagaaaggtccccctaatttcccgccccagaccctaaacctccaaagaggcaagacttaagatccagaaagccccgtaacctcccctcggccaccccagaggccctcccttctccgtaagaaggaccaaatgccccccagattacacaaggggtccttctcactccaaagtgacaccgccgcagacgcacgccccacaccccgccagcgcccttggcccgcacccgctcctgcgcgcacgcccaaactcagacccagccgcaggcaccctaactccggccagagttcccactcctcactgaggctcggtcacgggagcaaattcgggcccccg

SEQ ID NO: 387628 - DNA, 388 bp, Homo sapiens
aaaaaaatggtagctttatagtgaagaaagatggaaaacactaccttagccagataatcaagatcaacattagcagtgtaattgataagtaataaagttcatgttaatggtatgtacccttgatacaatgtgataaaaatggcactttatttctggggtcttcctccccaaaactcataatgccagtctaatcttgagaaaaacatcagacaaatccaaattgagggaacatcaatgttcaccttgtgtatttcttgggtcctgactgatactcctcaaaactgtcaaggtcataaaaaaccaggagtctgataaattgtcacagtgaagaggagcctaaggagaaaggataactaaatgtaatgtggcattctgggacaaaaaagaa

SEQ ID NO: 387629 - DNA, 261 bp, Homo sapiens
tatatatataaatgctatatatatataaaatgactacatttcaatgtatattggagttggtatggtggagagaagttgagcactttggagtcagacctgagtttcagttctggtcacgttatttaaatgcaccgagtcccatctgtaataacataaaagtaatactagtttgcagtagtatcatattaaatgataaaacagtgccttttacataataaatgcacaagaaatgtttttactgtcccttagtccataattaat

SEQ ID NO: 387630 - DNA, 533 bp, Homo sapiens
ggtgtgaaccaccgcgcccagcctaggacccacacattttaagccccggtgtagatgggtgttaccaaccctaaacccaaaaagatcactcctatgtaggatcattttggtttcattttcataacaggcaacatcgtactaactctcagaatcagcttttcctgggctctgtggtgaaagatgatgttgtcacctgtcactctgcacagagagagatgctttccagcccccgagaaagggccctccatgcctttggacacaagctcagcttccttcccctgtaactccaaaagcatttaaactcttttcctggccgggtacgagggccttttttttttttttttttttttttttgagatggagtcttgctctgtggcccaggctggagtgcagtggcgcgatctcggctcactgcaagctccgcctcccgggttcaagccactctcctgcctcagcctcctgagtagctgggactacaggcacctgcccccacgcccggctaatttttttgtgtttttagtagagatggggtt

SEQ ID NO: 387631 - DNA, 467 bp, Homo sapiens
aataatgatgtcttgggttcatcaagattcattgaagtatgttatctctttctctttcctccactttgggcgaagactatggtgttttgaagaagtagataccctaattcaggagtcctaatgatgacctatgcataaatacctgtgtggtgtttagaattgcctgggattcttgttttttgttttgttttgtttttgagatggactctcactcttgtcacccaggctggagtgtaatggcacgatcttggttcactgcaacctctgcctcccaggctcaagcgattctcctgcctcagcctccccagtagctgggattacaggtgcctgccactacacctggctaatttttgtatttttagtggagatgagatttcaccgtgttagccaggctggtctccactttctgacctcaggtaatccacctacttcggcctcccagagtgttgggattacaggtgtgagcc

SEQ ID NO: 387632 - DNA, 2053 bp, Homo sapiens
ccacctggcgttcagtacctcgtgcccgagagcggaaaagggaaatcgcgagcggaggaccgatgtgctggccacgtgggccccgccgggccgactccggaccctgctgccgcccattcctccggtgcaagggacctggaagtgatcccggtgccgctctgctcccaccagctagggagcagaggcgcgggagggaaggggcgtcccgggggtcgccagcacgctgcgggcagggctggcagccgcctccacgcccccgcgctggaagcctcgtctttgtaacatcgaggtatcctgtaactagatgggtcctggcctgcggaggtagtttcccctgtgaagccagggactcagccaggagcgtgaggggacccggatcctgagtctccaagccgcccactaccctctgctttaccggatggaactcatcagtaactaggtatctttaagggcggctccctggcgcgctctgagagttacggaagtcccaaaatgctttgaccgaaaacgtctaaacagtgaatacataaagcaaaaagccgcgtgggaaattcgagtccctaggagcgcccaggggacgcctctggaggtggactgccactcactccaggccacgctggaatgcccgcaccagggaggcactgcacttgaattggggacacttttttttttttttttcatttttacctttcattcccttttggacaatccagacaggatatgtctctccctagggtggggatttcgactccttagggtgggagtacagccgatgaagagttaaggagaggagtgggtagatctagatctagccttgggtgggtgggggcggggttggaggagctcagagcactggcccagcgctgcccccaacttgctgtgtgctcttggacaagttatctcccttctctgggcttcagataacccaaggatccttacatatctttatagctacaaagccctgtgaggttttgaaaaacttccttggtacccaaaaccaggtctgaggcacagtcagtgaatacctgtttaatgaatgcatgcataaatgaatgaatggatgatccagctcttcctggagcaggcacgacttccacagaaacagagcaaacgctagccgtaagcagaagtgagtcttcttcctatgtgaagggatgtgggggtggtacgcccctatcaactttatctttacatagtccttgagcgcccaccgggcaccgtgttccccggactagagggagggagaggggggttagctccacccttaacaagcttaattcttgatgagattaaccatcaaaacccatcagagaacgttatagctccagcgctgaatgagacatctttgattctgtggtgatgcggactttgtgcctctctgtgaggaatcactttgttccaatgacgcaattttcctcacactccggaagtgtcctgcactgccagaatcgcccagcttcccggcacacctatcaaccagtcgttcccagcactgcccagtatgcagcctccaggcagagggcctggatgtcttggcaggtagggttcccctagcagcctgggggtggtcagatagaaacattaactggaacgtagaggccagttcttggctcagggagccaggagggctctgactgttgcacatacaagccactcacactgctatcgcccacataccttcctctcccgccagcccaccccaaagcccaaactcctgcccgcatgctgggaaggtgagcccttgcctggagagcccagcaggggaaatagaaggagggaaggaggcctgctccttccccggagctctgctctgcggctgcaggaagacccgcagaggccctgggcagcagaactgtggacagcaaggctggagttgtgaaacccaaccactcagctggattccagaagctcaggtggtggtgactaaacctggccttacttaaaatgcatgactttattgtctttcaatgtattttcagtaaacttcatcctctccattactattttcttttcttcggaaacaagcaacagatctttgtaaaaaaaatacgta

SEQ ID NO: 387633 - DNA, 1511 bp, Homo sapiens
ccacctggcgttcagtacctcgtgcccgagagcggaaaagggaaatcgcgagcggaggaccgatgtgctggccacgtgggccccgccgggccgactccggaccctgctgccgcccattcctccggtgcaagggacctggaagtgatcccggtgccgctctgctcccaccagctagggagcagaggcgcgggagggaaggggcgtcccgggggtcgccagcacgctgcgggcagggctggcagccgcctccacgcccccgcgctggaagcctcgtctttgtaacatcgaggtatcctgtaactagatgggtcctggcctgcggaggtagtttcccctgtgaagccagggactcagccaggagcgtgaggggacccggatcctgagtctccaagccgcccactaccctctgctttaccggatggaactcatcagtaactaggtatctttaagggcggctccctggcgcgctctgagagttacggaagtcccaaaatgctttgaccgaaaacgtctaaacagtgaatacataaagcaaaaagccgcgtgggaaattcgagtccctaggagcgcccaggggacgcctctggaggtggactgccactcactccaggccacgctggaatgcccgcaccagggaggcactgcacttgaattggggacacttttttttttttttttcatttttacctttcattcccttttggacaatccagacaggatatgtctctccctagggtggggatttcgactccttagggtgggagtacagccgatgaagagttaaggagaggagtgggtagatctagatctagccttgggtgggtgggggcggggttggaggagctcagagcactggcccagcgctgcccccaacttgctgtgtgctcttggacaagttatctcccttctctgggcttcagataacccaaggatccttacatatctttatagctacaaagccctgtgaggttttgaaaaacttccttggtacccaaaaccaggtctgaggcacagtcagtgaatacctgtttaatgaatgcatgcataaatgaatgaatggatgatccagctcttcctggagcaggcacgacttccacagaaacagagcaaacgctagccgtaagcagaaagaacgttatagctccagcgctgaatgagacatctttgattctgtggtgatgcggactttgtgcctctctgtgaggaatcactttgttccaatgacgcaattttcctcacactccggaagtgtcctgcactgccagaatcgcccagcttcccggcacacctatcaaccagtcgttcccagcactgcccagtatgcagcctccaggcagagggcctggatgtcttggcagcccaccccaaagcccaaactcctgcccacatataatcccagtgcctcgagaggccaaggcaggaggattgcttgagggcaggagttcaagaccagcttgggtaacatagggagaccggtatctataaaaaaaattaaaaacaaaaaaattaaa

SEQ ID NO: 387634 - DNA, 536 bp, Homo sapiens
tgccccaggaaggcttgtggacagagggagaagcatctcttcctctatgtctctttttatctaagaaaccagtttgaccagcatccttcccctcggctccccaggaggaatgcacggatcccttcgccttcccccatccctccatggttgactaaacccactaggatccactcttttgcgtggaaatgggttcaggcctcccacgaagagcatgaagatgccctctgttatgggttacattatgtcccctgcccccgagaccgtatgttgagtcctaaccctagtattgcagaacgtgaatttattaggagatagggtctttatggaggtcattaagttaaatgagggtgttagggtgggctggtgtcctgatataaaggggaaatttggggctgggtgtagtggctcacacatataatcccagtgcctcgagaggccaaggcaggaggattgcttgagggcaggagttcaagaccagcttgggtaacatagggagaccggtatctataaaaaaaattaaaaacaaaaaaattaaa

SEQ ID NO: 387635 - DNA, 1899 bp, Homo sapiens
ccacctggcgttcagtacctcgtgcccgagagcggaaaagggaaatcgcgagcggaggaccgatgtgctggccacgtgggccccgccgggccgactccggaccctgctgccgcccattcctccggtgcaagggacctggaagtgatcccggtgccgctctgctcccaccagctagggagcagaggcgcgggagggaaggggcgtcccgggggtcgccagcacgctgcgggcagggctggcagccgcctccacgcccccgcgctggaagcctcgtctttgtaacatcgaggtatcctgtaactagatgggtcctggcctgcggaggtagtttcccctgtgaagccagggactcagccaggagcgtgaggggacccggatcctgagtctccaagccgcccactaccctctgctttaccggatggaactcatcagtaactaggtatctttaagggcggctccctggcgcgctctgagagttacggaagtcccaaaatgctttgaccgaaaacgtctaaacagtgaatacataaagcaaaaagccgcgtgggaaattcgagtccctaggagcgcccaggggacgcctctggaggtggactgccactcactccaggccacgctggaatgcccgcaccagggaggcactgcacttgaattggggacacttttttttttttttttcatttttacctttcattcccttttggacaatccagacaggatatgtctctccctagggtggggatttcgactccttagggtgggagtacagccgatgaagagttaaggagaggagtgggtagatctagatctagccttgggtgggtgggggcggggttggaggagctcagagcactggcccagcgctgcccccaacttgctgtgtgctcttggacaagttatctcccttctctgggcttcagataacccaaggatccttacatatctttatagctacaaagccctgtgaggttttgaaaaacttccttggtacccaaaaccaggtctgaggcacagtcagtgaatacctgtttaatgaatgcatgcataaatgaatgaatggatgatccagctcttcctggagcaggcacgacttccacagaaacagagcaaacgctagccgtaagcagaagtgagtcttcttcctatgtgaagggatgtgggggtggtacgcccctatcaactttatctttacatagtccttgagcgcccaccgggcaccgtgttccccggactagagggagggagaggggggttagctccacccttaacaagcttaattcttgatgagattaaccatcaaaacccatcagagaacgttatagctccagcgctgaatgagacatctttgattctgtggtgatgcggactttgtgcctctctgtgaggaatcactttgttccaatgacgcaattttcctcacactccggaagtgtcctgcactgccagaatcgcccagcttcccggcacacctatcaaccagtcgttcccagcactgcccagtatgcagcctccaggcagagggcctggatgtcttggcagcccaccccaaagcccaaactcctgcccgcatgctgggaaggtgagcccttgcctggagagcccagcaggggaaatagaaggagggaaggaggcctgctccttccccggagctctgctctgcggctgcaggaagacccgcagaggccctgggcagcagaactgtggacagcaaggctggagttgtgaaacccaaccactcagctggattccagaagctcaggtggtggtgactaaacctggccttacttaaaatgcatgactttattgtctttcaatgtattttcagtaaacttcatcctctccattactattttcttttcttcggaaacaagcaacagatctttgtaaaaaaaatacgta

SEQ ID NO: 387636 - DNA, 319 bp, Homo sapiens
ccttgtcaccctacttctccagcctaggaaagaaaattccacgagagaaagcaagcaagaggcttagagggcctgtgatcacagctgagactcactcttcctttccctactcccacacagacccccgaaagccaacactcgtggtaatttctgcattcgacttttgtggcctatgtggagcctgttaggtttaaaagctcccaataatagccttgtgagggatatactattcttccttgtttttatttccattttacagatgataaacatgaagcccagagtggtccactgatttcccgaggccacatctgtacacagc

SEQ ID NO: 387637 - DNA, 224 bp, Homo sapiens
atgatggattgagtgaagagtatgaggaatggtaatatattgtatgaggagtaaataatacctctgcagttttgatttaaacaaatacgggaatactgaagaaagattgggtttggagggaaaggtgaaaattctttggaggtctttttctcatattaaattcacgtacaagtggaggtgttaagtaggcagaagaaataaagcagagggaagaggtagaaagt

SEQ ID NO: 387638 - DNA, 484 bp, Homo sapiens
gagacagggtcttgctctgtcacccaggctggagtgcagtggcacaatcactgtaaccttgaattcctgggttcaagccatcctcccacctcagcctcccgagtagctgggacttcaggcatgcaacactatgcccagctaagtttataaaatttttctgaagagatgaggtctcattatattgccctggctggtctcaaattcctggcctcaagtgctccttctgcctagccaaagatggacttttaataagcggtttgtgatgccagatagccatgttgcaaaaattagatccattctccataccatacaacaaaataaattcatacatgtaaatgttcatgataaaatcacacaagtactaaaagaaaatacagatgactgtctctacaactgcactgtccaaaatggtagccattaaccatatgtggctactgagaccttgaaacatagatagtgtgaccgaggaactaaattttcagtt

SEQ ID NO: 387639 - DNA, 832 bp, Homo sapiens
  misc_feature (11)..(11): n is a, c, g, or t
taatccttctntgatattactggttcaggattttaattctaactacataaattaccagacttaaaaatcaagatgggggctggtcttgaactccagggctcaagcaatccacttgcctcagcatcccaaaatgctgggattacaggcgtgagccactgtgtccggcgtcactgtctttaaaaggcagtttagcatcgtgggtagagagccttgggataagattgtctgggatcatatccctgcaccaccacatacgtaactgtgccactgtaaggcaagcaatgtcctctaaggtaaaatgggaataataatacctaccttgtggggttgtggggagatatgagaaaatgccaaaaataaagtgcttagcacaaagtacttggataagtgcttcccagatactgggataagtgcttcctaggtacttgttcctgttataaatatgactattagaagcaaaggagcaggaaggtactaccagatggtcctgggcagccatggagttacagccacagagaagaggacaaaatgggctaagagtaagaaagaacaaagagactgcatagaaaagcttaaccttgacccccatatcaaacattaaaaaagaaaaaagctggcatgattaatccccaaacttgtgttagtacttgaatttggaaatacctgatcctgcgcggtcggtctgtcccacgaagttctcacggaaggggaaagtgagacctggttatcgctacctatattgtgaaactctgggtattttcttcttgaatccacctcacaaagaacctctagcaggtttaataccaatggaaaagtcatttgtggacataac

SEQ ID NO: 387640 - DNA, 388 bp, Homo sapiens
gagaggtcagagtgttggcagcacattacatatcatccatgaaaataaaactgctgtgaaaccacaaagggtgggaaagttttctccattagtatactaagtagtgttacctgacacaaagccagtaaacacagcttagaatacctgagtatttcattaatctaacatgggccaaatggagagtttcattgagatctgatatgatttatttagctgattcctactggtccctagcaatgacttcttaagttgtcacacagacgatgattcaaataagaaataaattttgaaaaattaattataaatgtcatgggccacataaatctaggtagcattgtgctctgaaagtttaccattgcttttactttcatgccttgtagtttcacag

SEQ ID NO: 387641 - DNA, 647 bp, Homo sapiens
gctcacgcttgtaaccccagcactttgggaggccgaggcaggcagatcagttgaggtctcaactgagttcaagaccagcctggccaaaatggtgaaacctcatctctacttaaaatataaaaattagccaagcattgtggcaggtgactgtaatctaacctactggggaggctgagggtggagaatttcttgaactcgggaggtggcggttgcagtgagccaagatcaagccactgcactccagcctggacgaaagagtgagactccgtctcaaaagataaaagtatagagaaaaatcaaacaggtcaaggggttgagttgactgttattttagacatagttattagggaaggcctatctaaagaactgctagtaatcccagtattttggaaggctaaggagggaaggattggttgagcccaggaatttgagaccagcctaggcaacacagtgagacctcatctctataaaaaatgtttcaaaaaaagttaaccaggtgcagtgtgcttgcttgtagttccagctactcaggaagctgatgtgggaggattgcttgggctttagaggttgaggctgcaatgatccatgatcacaccactgcactccagcctaggtgacagagcaaggccctgtctcaaaaaaaaaaa

SEQ ID NO: 387642 - DNA, 564 bp, Homo sapiens
cagtcaatatcatacttggccttggattctctcctgaaacatccagaggccttccctggtgctgactgatgaaggaattccatttcatgagacttaggccataaaaatatgcttactgcaaaatggccaactatctcctcttcttggatttgggctggctcaaaattattcagaacaacactatatacaaatatgcatatatacatatgcatacacaagcataatagtcaacacattttctttgtagaaaatttaaattaaagtgcacagtgtcagagtaacagaatgcaggtcagcaggatttagggcccacgtgaacgcacacaggggctggggctttgggctttggtaaacgctcaataaatgtcagctgaatgaagaataaactttttctggctttatctctcctttaattcttgaactctcatgacttccaagggggttttgcaggaaagagccagagaaacagagaagagagtgaggttcccttggatattgaagggaggggggctgtagcagctggccacccacttggcaggggtgaggcagaagcaccgatgaccc

SEQ ID NO: 387643 - DNA, 786 bp, Homo sapiens
acctatggatataggtggtacctacatgggaacacattgtctaataccacccagaatgggtagcaaagttcatagtgaagtttccactgtgagcggcaggtggcgggctcttctgagaaagaagcttctagatgcatattgtggggagcagatgaaactctgaggctttcagggacgtgaggtacggtgccaaggccacaccactgagacaggggtctcactatgttgcccaaactggccttgatcttctgggctcaagcaatcttcccacctcagcctccgagtcgctgggattgcagataaggaaattgaggctcagtgttggcaggtaacatgttcaagatcttgaaactagcaggtggcagagctggggttcatctgtctccatgtgctcagaattctgagaggaattgctgaaaaggatggggactctgagctacatatgcatagcattgatttcagtgagaaaactacatatttttgaccatatgaaaaaaaatctgttcttgaattttgatgatatttgcatagtttttaaattacctctggcagaaaaattatgtcaaagatgaacctaaacaaaagggaatgacatgttgtttggattactgagccagagaagccgctggaccattgagatttagtaggcaatatgtttgccagcctttttgaaaattggaatgttatttttgaactttatcgaagaacatgctgcatctctaaggcctgcaagattattctgtgcccatcccatttatggactgcaaacttacttgattcctgata

SEQ ID NO: 387644 - DNA, 145 bp, Homo sapiens
tgagccaccacgcccagccaaactagctttctgagatttgttttggtgtgaggttggtatcctgtttatgttgtttcaactagttagccattttttctggctgatgttaagtcatttaagaaatgctttttgggtgccttctctg

SEQ ID NO: 387645 - DNA, 821 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387646 - DNA, 836 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacggtacccaaacaggcaaacaacagctggatctgaacgcatgctatcacaaaacgcatcacagaaatttggggctggcttcattggaagaggcagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387647 - DNA, 878 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctcctcccaagagaaaaacagaaaaacgtcaggaagatagaagaaagaaggaaacacgga

SEQ ID NO: 387648 - DNA, 847 bp, Homo sapiens
ccatgggaatatccccggggatttcccgttatttcttgcccaagggccttatcccggttaaattgtagcgcggcgagggttttgaccaccaattttgaacttaagcgcaagggctttttttattacccccccccacagacttctttggttaattccttccctcccacaaggagcttggacaggtactcccctaaggctttgagtttaagagaagggttctgaaaaaatagaagatttccgcctccgccccagagccctgaatggatcagattatgaggaggtacacgataggcacacatagcctcaagatcacagataataggaaaacagtaaaattcaggaagtgatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387649 - DNA, 890 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagagtacgtttccagtattcttattcttatggtatcctatgttgatcttggtcaacagtgcagtcttggtggtcatgatctgttccacctatgttgaacactgtgttagaagtctggggctagaattattgatgcctgctgaatccaaggtttggttaatcccgcttcctcaactgaaggtctggaccctggcattgatgcccatgtcctatctcccactgtgtggttttagaattatatgtccaggtatcagggtactggcccatgccttctgcattattgatatagatgggcagaagcaataccagcttctaagccttgccttctcataagacttatatcagaaaagaaagaagttttctagataaaggtgctgtgaaggtagggccacccagtttcctactcccaggggcggaagctgcattcatgtcatagcctctgtgatgctgtcctctggaatagtgcatcgcacagcctgtgcaaccacacacggcacacccagtggcctaattaggtttgactaagttgacagagaaaaacaggttcagggacattttcatctaggagaaagaatggatacaataaacatttgggatgttcctttccgtgtttgaaactca

SEQ ID NO: 387650 - DNA, 812 bp, Homo sapiens
ttcgtgtgaagggcacagaaaagcagttccaaagtctgaagcctgaactgcgaggcgaggacatccctttttgctcgttgcaagtcgcaagtgctgacagctaacaacaccaaataagacccagggtctcagtcctaagaaagcactctataaatcagtcagttaattgctgaaagaaaagagggcactgaatcatctgtatctatttgaattttaagccactcgctcaacctgcacttacactctcaacaatccaatttggagtgaggctgacataaagctgtaagaaggcactacagcatcttcagttctctcatgctggttgtggggcttgtctctaaagaggactgcagacaaataaagcacttgagatatactaatttgcctccacttttgaaaccttcctcaagatactacctggtgcatgagactagtgggctctcaaaaaccttgtcttttcttttttttttcaggtttaggaggaaggcttctgaagaaatagaagatttccgcctcagaccacagagcctgaatggatcagattatggaggaggtaagaggcccttggaggaagtcaaaaggtcttctagagaggccccagaacatttcctgggctacagctaaggcactgttggctgcagcatcactgaagacatttgcagtggtcttctgacgcatgctgatgcacatcttcatgccttgctgaatgctgccacctctacctggagtatctctcccttctttatctgataaccctgcttatccttcaaaaggtcagccaaagcatcacttcccctgaaacatcttccctt

SEQ ID NO: 387651 - DNA, 747 bp, Homo sapiens
agcgtcacgtcaggcggccgcggagatggaggatttgctcgacttggacgaggagcttcgctacagcttggctacctccgtgaggaccaattcgggggccttgggggccaggatttggcgggtggggaggagcgaccccgccggccccgacttctctgaggcgactcagggcggcaggcctcgcgccgcgccgggtgaggcccagaaggaggcagcctcaccgccccgcccccaggccactgtgggctccgccgctgctggcctggggtttgctttctttaaaatcctcagaaagtagaaaacaccctgtccccgccggcgtctaggaccgtgggaaatttccgagcctttctccgttttctagagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggaggcaggcagggacggcctttcttcccgagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacccagttctcctcctggacagccatttgcctgcttgatg

SEQ ID NO: 387652 - DNA, 481 bp, Homo sapiens
agggtcctccgcggaagggcagctgaatggactccagagcagccttaaccctgcagcctttgtgcccatcaccagctctacagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtgagtaccagcagctcataagagtatgggtgggggtgcacacggttggggggactttgctcctgtgttgttttattttttacaatagctttattgagaaaaaatttatataccatacaattcacccacttaaaatgcacaatttaatcattcttaatatattcacagagttgtgcaaccattaacacaatcaattttacaacattttcatcacctccccaccaaaagaaaccctgt

SEQ ID NO: 387653 - DNA, 279 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacccagttctcctcctggacagccatttgcctgcttgatg

SEQ ID NO: 387654 - DNA, 936 bp, Homo sapiens
agcgtcacgtcaggcggccgcggagatggaggatttgctcgacttggacgaggagcttcgctacagcttggctacctccgtgaggaccaattcgggggccttgggggccaggatttggcgggtggggaggagcgaccccgccggccccgacttctctgaggcgactcagggcggcaggcctcgcgccgcgccggagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387655 - DNA, 1289 bp, Homo sapiens
agcgtcacgtcaggcggccgcggagatggaggatttgctcgacttggacgaggagcttcgctacagcttggctacctccgtgaggaccaattcgggggccttgggggccaggatttggcgggtggggaggagcgaccccgccggccccgacttctctgaggcgactcagggcggcaggcctcgcgccgcgccgggtgaggcccagaaggaggcagcctcaccgccccgcccccaggccactgtgggctccgccgctgctggcctggggtttgctttctttaaaatcctcagaaagtagaaaacaccctgtccccgccggcgtctaggaccgtgggaaatttccgagcctttctccgttttctagagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggaggcaggcagggacggcctttcttcccgagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387656 - DNA, 1054 bp, Homo sapiens
ttcgtgtgaagggcacagaaaagcagttccaaagtctgaagcctgaactgcgaggcgaggacatccctttttgctcgttgcaagtcgcaagtgctgacagctaacaacaccaaataagacccagggtctcagtcctaagaaagcactctataaatcagtcagttaattgctgaaagaaaagagggcactgaatcatctgtatctatttgaattttaagccactcgctcaacctgcacttacactctcaacaatccaatttggagtgaggctgacataaagctgtaagaaggcactacagcatcttcagttctctcatgctggttgtggggcttgtctctaaagaggactgcagacaaataaagcacttgagatatactaatttgcctccacttttgaaaccttcctcaagatactacctggtgcatgagactagtgggctctcaaaaaccttgtcttttcttttttttttcaggtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387657 - DNA, 1242 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctcctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataaggagactcattcttcactcgcatcagggtttggtggctgttgtgacaatattctcctttctcccctcttcctgcagtccatgccttgagctccaaaagcttctacag

SEQ ID NO: 387658 - DNA, 1238 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggtacagtggtggcagcaattccccggtctctcagctctggcattcccataaccagccgactcccgggctggcctgtgcctccctgaggcctggatgggagggagaagtcagctacagttgagggaaaaggcctttctttgtcttacccagcgaaacccttcttggcaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387659 - DNA, 1070 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387660 - DNA, 1132 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataaggagactcattcttcactcgcatcagggtttggtggctgttgtgacaatattctcctttctcccctcttcctgcagtccatgccttgagctccaaaagcttctacag

SEQ ID NO: 387661 - DNA, 419 bp, Homo sapiens
tatggtcctttgccccaaagcacgcccagcatgtgggaagcatagccttccctcatttctcagtgggcatgtggttcattcatgattttactctcttgtgaaggcattcctgcaggtctcagtttgggaagttctgacacacaaaaactgatcccggttttgtgagaaagagttgcctgaaagccctcaaggtgctcagcctgacctttttttgtttgcattcacaggatggggagatcgacctgaaactcctcaccaaagtgctcgcgccggagcacgaagtccgggaggtacagtggtggcagcaattccccggtctctcagctctggcattcccataaccagccgactcccgggctggcctgtgcctccctgaggcctggatgggagggagaagtcagctacagttgagggaaaag

SEQ ID NO: 387662 - DNA, 1052 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaaatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataaggagactcattcttcactcgcatcagggtttggtggctgttgtgacaatattctcctttctcccctcttcctgcagtccatgccttgagctccaaaagcttctacag

SEQ ID NO: 387663 - DNA, 1001 bp, Homo sapiens
agcgtcacgtcaggcggccgcggagatggaggatttgctcgacttggacgaggagcttcgctacagcttggctacctccagacggggtttcaccgtgttagccaggatggtctggatctcctgaccttgtgatctgcctgcctcgtcctcccaaagtgctgggattgcagctgtgagccactgcgcccggctggattgtcatctcagtagtggcccaaatgacatttgggtcagcagtgccttcagtttctccttacagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387664 - DNA, 978 bp, Homo sapiens
agcgtcacgtcaggcggccgcggagatggaggatttgctcgacttggacgaggagcttcgctacagcttggctacctccagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387665 - DNA, 1073 bp, Homo sapiens
agcgtcacgtcaggcggccgcggagatggaggatttgctcgacttggacgaggagcttcgctacagcttggctacctccagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagcggtacccaaacaggcaaacaacagctggatctgaacgcatgctatcacaaaacgcatcacagaaatttggggctggcttcattggaagaggcagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387666 - DNA, 989 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggtacagtggtggcagcaattccccggtctctcagctctggcattcccataaccagccgactcccgggctggcctgtgcctccctgaggcctggatgggagggagaagtcagctacagttgagggaaaaggcctttctttgtcttacccagcgaaacccttcttggcaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387667 - DNA, 1229 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaaccgcaaagaacccggaatcagtatggcatgaccggagtcctgggcaacgtgggttcttaactgtcagtcagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggtacagtggtggcagcaattccccggtctctcagctctggcattcccataaccagccgactcccgggctggcctgtgcctccctgaggcctggatgggagggagaagtcagctacagttgagggaaaaggcctttctttgtcttacccagcgaaacccttcttggcaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387668 - DNA, 839 bp, Homo sapiens
agcgtcacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggagcgaaacccttcttggcaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 387669 - DNA, 478 bp, Homo sapiens
cagttctggaaatcgcctggatccaaacagctgcaacttttgggcagagcctcagatatttctctaggcctccctgccgtacggccagaagcctgtccaaacaagttatcatttgccttatgttaatgtgataagcagccctcgatatccaatggaaagatcaaaggttcttcattcaaaaagaagcaatatccttttgcctgatatggggtgggaagggtaggtggcgatgatatttcaaatgaattagaaaccacctcccatttgatgatagctggagaaatggactgacctagaagttacaggaccagaaactacagtcaccactaacctttctacgtggcacccagccccacttggagacattatttttccatcaaacacaaccgtactgcacagacatcttcactgtctgttgcaaagattggaatacgtagatttctgttcaaaattaaataatattttaaatacattacta

SEQ ID NO: 387670 - DNA, 343 bp, Homo sapiens
aaccagacaaggaaggcttcctggaggaggaaccatggagtggtgaaatgggaaccaaagaaggaagaaagtaagaaatttcaggcagagagagcttcgtctgccaaagcagttgcttcagtggaactgaacggctggaactagcctccacaagagcagagaacaagagagaaggagggtcatgggctcaccatcaccagcactgaggtcctgcggcagatgtaacatgaagctacccttcaggagctggtaggagaggccaagactcaagctgcctaaagaggtagccaggtttgggttgagtcttccttaaggcctaggactccttaagtcttcctacttc

SEQ ID NO: 387671 - DNA, 385 bp, Homo sapiens
gcacgaggaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcagtttcatataactgaactcaaacaacctcgctgaacaatgctcatttgggaagtgggaaggaaatttcctttatgtagttgagagatgtggctaaagataaaatccacgtagcttccggcaataatgtaagcagcttccaaattaaaaaagaaaccactgtattgaattctggtcttgctgtgtgttttaattacccctgtatta

SEQ ID NO: 387672 - DNA, 1005 bp, Homo sapiens
gacttacactgacactgaccactctcacttctgctctttgtgcacaggagccattccttcctgagtgcctttgtcacagccacagcttcagtcagaggggtcagcatctgttggccttgacttgattttgcctatatgttgttaatgatgctttttaaaaactctgtaaagtcaggttatttccctcgctttatttctaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggtatgtgaagggccctgcaactagcatttgggttactcagggatggcctgtgtcccaagcaagccattcccaccttgagttctgtatggagatagcactaaggcatatgccctttctccacctgcctcgatcctactctggcacctgactaagggagcctcattttattggtaagacagtttccaaggcatatcaaatgaaaaggaccatttctgagatagttaagaaaatcaccttagggtaaaagagcaagaatttacactatgtttaaaccttgcttatagtcatcatttttatgtgccaactttttgcactttgtccttgtctcttagttttttttttaataccttgtgttgtttatagttttttttatactacattgtgtttcagtaactgtagactctgttcttttgaaggacatatttgtttcttatttttttatctagtttcatataactgaactcaaacaacctcgctgaacaatgctcatttgggaagtgggaaggaaatttcctttatgtagttgagagatgtggctaaagataaaatccacgtagcttccggcaataatgtaagcagcttccaaattaaaaaagaaaccactgtattgaattctggtcttgctgtgtgttttaattacccctgtatta

SEQ ID NO: 387673 - DNA, 4318 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387674 - DNA, 4063 bp, Homo sapiens
  misc_feature (4053)..(4053): n is a, c, g, or t
gcaaaccccaaggcttgtgctttaagtgtgagaaaccatgggctgagtgacacccactgtaactcaaagcaagcaagtttctcgtggcacttattacattacacagctgagcatttctgcccccacccagtgttgcagtgtaaaaatgcctgcctctttgctaaaagcctctacttgcttgagaaacttccttttgtgatttgtagactgggcttatgttactgaggagattaaaaacagatttcattataaaagtttatgatgttccagtccgttcaatatgtgtgcagttggaggaacacatcctttcttatccataattccttatttgatcttctcttgcccactgtcctaccctttatatatccacagacccccacctcatattcacacacctgcaaacctgtccatgatcatccccacataaaggggcctggtttggtttcagactttgatttctgatacacaagaaggcattaaagtgaatgtctcctggggatatttgttattaaaacagcttttagcaaatgaaccaatctagccagtgagatgaattctgatgtaagcttcatagttatataaatactgtaaaatctaatcactgagtctagattgctttctgtagctagcaacttctgtaaccagcaaagcaggaacgaaagcagaaccactgttgatgggctttctgaactttagtccagttgtaactaatagtttaattctggattcaaagcagcacctgccctaattggtgtggaaatctcaaggttagccagctaaagcagtttcttctttttcacctgtttctttcctttgtattcatttgttcactggatcagcccactcctgccttgaacctagatacctttcttggtggctccccctttcgttcacagctcactccgttcctttagctgagccagtagctgttgagtagttttgggtgttttatcttcagtaagcttttctcttccctcactaatgagaaaagagataataggttcctcaggctcctcctttcctaacgatgtcatcctgttttactgtcactcagcaccctgctttgtgaataatgttaacatttcactaatgtattgaagtatttatttatatttgatcagtgctcaccatgtttctccatacgtctagaagtctcttgggaaagatcatgcccttttaactgtctgataacatgcacactgaggcacttcaagaaggatcactgaagatcaaatgtcgcactcagaaaacttaatagataagctctgagctttttggtgtgttctccaagaagattaggagatggtatacaattgagcaactgaactgtgggagccaaactgtgggaggagatgagtaagggatgtgacatatcagaggtgagattatgggatagaaagccgaaagaatacagttcacggacttacccttaacgagagatttggaaatctctctaagagagttgggaaaccaaagcagaggcccgaaaagaccaggttgtgagggagggcacaggcaacagaggagcatggacttctgagcttggcaaacatttcactttgctccctccttcagtgctctgttgagtcatcaggacccaggctataaataaccctatgtggcttttaggtgaggactctggaaggtctgtgtagcctcacttcagggttcctacacctctgtcattgaaatgactttaatgacaaaggaaagaataacactgatttaaatcactatgaatacttttctcaatttaggcaccctttcatttttctaagcccccttaaccagggtttggagcaaggttgttcattatgaaagtcttatgtttcttctatgtacaattttcctgtcactgtacctaaaaaggaaaagaaatacagtgtaattaaagatggtcccaagaagaataaccaaaagtgttaaggagatggaaggactgacaagactgttctcaaaagaaatgagacctttagaaaatcatactaaatatatttagcataaaatttaccattttaaccattttaaagtgtacaattcagtggtatttagtacatttatactgttttgcaactattagccaccatctgtctccagaactttgtcattatgccaaactgaagctctgtactcactgaaaaatgacttcctattccctaattccatagcccttgataatcaccattctactttctgtctctaaaatttgcctattccaggtacctcacataagtggcatcatataatatttgttctttcgtgactgacttatttcacttagcataatgtcttcaaggttctgtacatgtgctgcagcatatgtcagaatttcctttctctttaagcctgagtaatattgtatgtagattcatctgttgatggacatttgggttgttttcaccttttgcctattttgtacaatgctgctatgaacattggtgtacggttattagttttgatttcaattcttttctgtatatatctacaagaaaaattgctggatcatttggttattttgtgtttcactttttgaggaacccctaaagtgttttccagagtaactgtaccattttactttcccaccagcattgcacaagggttccagtttttccacatcctcagcgacccttgttatcgtcaggtattttgttttaataatagccaaatgggaatgaagtagtataaatggggtcttttctactgggaaaagtgatctgagaggggaaatgtaggaggctatagttgtaaagacttctgctaggaagtacacagacatggtcaccagaatctagaatttggagctgggtgcagtggctcacgcctgcaatccaagcactttgggaggctgaggtgggcagatcgcttgagcccaggagtttgagaccagtcagggcaacatggttaaacccccgtctctacaaaaaaaatatataaaaattagccaggcatgatggcacacacctagaatcccagcttctcaggaggctgaggtgggaggatcacctgagcatggggaggttgaggctacggtgagctgtgattgcaccactgcactccattctgggctacagattgagaccctgtctctaaataaataaataatttgggcaaggaagatagtcaaagtatttaacaaatactataacatagcataggtactgactactcaaaaaggccaccggcccttcgccttcctcaggtgtacagattgtcagcctcagtggggaccctgtgaggtaaatttggaataatgaaaaaaagtgtcttcccacaccatttatgttacccagtcatagggacataagctcaaatataaacaacttctaaaaaatatttagatatttaactgatgggtggttgagagaaaacaaattctgtgtgatgaacccttttccttttgaagttgatgttagagaaaatgatcatgcatctgttcctgccttaagttagccccccatcctgcattggaagctctctggactcttcttgtaggtcttctggcaatcacaggggaatgaaattgctatttcagttgttttacatccagctaatatttattgtacattgactgtgtgccaggccttatgatacgtgctaggaaaagaagagagtgcaaaacagaccctgtccttgtcatcatggagctacggtttagtgggggagtcagataatatcacacaagtagatttgtaattccaaactgtgcttggttccatattggaaaaatacctgagatatttctctcctttcctctagattgttcatacagccactcactctaagaaacctgcttgcttttctcttcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggtaattcaagataagtcttttccatgtgttatatcttcctgctgttggtnaaaaaaaaaa

SEQ ID NO: 387675 - DNA, 469 bp, Homo sapiens
ggaccactcaggtagcttgaagaggatggatttggaggatgaggcagtgccactcctttttcctccatgctcgctggtgaagataatgaggaacagtgaactagctaaaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcagtttcatataactgaactcaaacaacctcgctgaacaatgctcatttgggaagtgggaaggaaatttcctttatgtagttgagagatgtggctaaagataaaatccacgtagcttccggcaataatgtaagcagcttccaaattaaaaaagaaaccactgtattgaattctggtcttgctgtgtgttttaattacccctgtatta

SEQ ID NO: 387676 - DNA, 3486 bp, Homo sapiens
  misc_feature (137)..(137): n is a, c, g, or t
  misc_feature (181)..(181): n is a, c, g, or t
tcttgtgtattgtgttgtgttgtatttctagaactctatggctttgacgtgctcatagattctactctgaagccatggttgttggaagtgaatctctctccttctttggcctgtgatgcgccgtctgggacctaaangattaaaggccagttatgactttcaggattatggtgtcacatgnttgttgaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387677 - DNA, 3106 bp, Homo sapiens
tgagtagatctgccggtctcccttatagatgaggtcgatatgaagtaacgtagatcgccaggagttagcctgcttcactgattcggaatctgaacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387678 - DNA, 4981 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
  misc_feature (4378)..(4378): n is a, c, g, or t
  misc_feature (4381)..(4381): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttataaaaaaaaaaaaaaaaaaaaaaaaaaaaaaaaaaaaaaaaaaaaaaaaaaaaaaaaaaanaanaaaaaaaaaaaaaaaaaaaaaaaaaaaaaaaaaaaaagagagaggaggcgagcgcgccgccgacaacactcccccagcagggggcgcaccagcacacgccacccctctttgagaaaagggggcccctcctaggagtgcgtattatatatataaaaagcagcgaacagaggcgagcggcgcgtgcgtgatatataaataaacacacaactggatggctgcaggggaaaacaaatggggctgctttcgcgggaggaatatctgacgaggatactagcgaaaactcactctactatcttactggtggagggggagaagcagaacaaccgagagaggacggagcgagaaacacacccaccacgccgaaccgggaggaagagagaaaagaccaagccgccgccgcgggggagagacaaacacaaaaaagtagctcagtcgcgagcgaggtcagacagatgagagcgagcggaccgagccacaccaccacccagcgacagagacaagtcaaagcggcgcccggcagcgaaagaaagaaaaacaaacaggcgcgcacgcaaacgaaaagaagagagcaaatcgtctctagcccaaaaccaaccaatt

SEQ ID NO: 387679 - DNA, 4264 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaatttcctagagagaggagacaaatcggtgtgccattgacaacatgagccagggtaaaggcaccctttggaattactgatttcaaagattaataaagtaattctatttttat

SEQ ID NO: 387680 - DNA, 4409 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagaatgttgccagaagatactaccagggctgcccagatcagttggaaaggccttagggacaaatctttaagaggtaaacgtctttgcatttagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387681 - DNA, 4389 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagaatgttgccagaagatactaccagggctgcccagatcagttggaaaggccttagggacaaatctttaagagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387682 - DNA, 3814 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggtatgtgaagggccctgcaactagcatttgggttactcagggatggcctgtgtcccaagcaagccattcccaccttgagttctgtatggagatagcactaaggcatatgccctttctccacctgcctcgatcctactctggcacctgactaagggagcctcattttattggtaagacagtttccaaggcatatcaaatgaaaaggaccatttctgagatagttaagaaaatcaccttagggtaaaagagcaagaatttacactatgtttaaaccttgcttatagtcatcatttttatgtgccaactttttgcactttgtccttgtctcttagttttttttttaataccttgtgttgtttatagttttttttatactacattgtgtttcagtaactgtagactctgttcttttgaaggacatatttgtttcttatttttttatctagtttcatataactgaactcaaacaacctcgctgaacaatgctcatttgggaagtgggaaggaaatttcctttatgtagttgagagatgtggctaaagataaaatccacgtagcttccggcaataatgtaagcagcttccaaattaaaaaagaaaccactgtattgaattctggtcttgctgtgtgttttaattacccctgtatta

SEQ ID NO: 387683 - DNA, 3992 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggct

SEQ ID NO: 387684 - DNA, 1164 bp, Homo sapiens
gcgagtagaaaggaaatcttcccccatagatggacacttgagctcttgttggttttagcatctgaactgaaccagatgcctgcattactcatgagaaattaaaaaggatttctgggaggccatgagggcttggtggtgctgctgtagtcagcggctcccatgtcccatgtggctgcattgcagagttccttgggctgtctttgctctgaacaaaccccttgcagctgtgcccggcgcctttgtgacaacccaggcaaggtttcatgaaatggatctgatgttcttgtgcctgtgttattcattccaacatactggagctatgcccaggaaggtgaggggcagcaggttggcccacacaccccagctgtccgtttctactaatgtcactcaggatataaataaattgattcattcacttcctttcttatcaaaccagaatgttgccagaagatactaccagggctgcccagatcagttggaaaggccttagggacaaatctttaagagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387685 - DNA, 413 bp, Homo sapiens
caaccagcgtgatctcttagaaccctcagtctgaattcctggcataaatctgactgcccttattattattattatttttccagataagccctagcttgttggctgtccgtggatggctgccctgggtttaggtaccgttcgccagttcagttaactgtagctgggattgggaatagctgggaatcatttaattggttgcctactccttagggctgtgggtgtcttcatctttggaaaagtgtgatgagacgtgccatgtttcccagcattgattagcagttgtgttatatttttgggaataaaattatgtatagaacagcggacttgcaattgattataagagagtccaagctcattatttcttatttcagatcaccctgagactataatggaagaagtgaaaataaagccac

SEQ ID NO: 387686 - DNA, 345 bp, Homo sapiens
caagaaagcagatcttctgggttgatggaacttggcagtggggacattcagctgatgcattatataccccgtcagagcacacttgttgtcccagtgaaagtctgcattggctgattggcaaccatctactgccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggct

SEQ ID NO: 387687 - DNA, 4374 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggccaaagatgttgtaacctgggagacttctctgaagaaagaaaactgtttaagaaacacagactgaactgcagtacttttccttaaatagctgagatgaccttctttaccctgggcttaggtgattctcatcagggtgacctgagtggaagttggtggtaacgactgttctgtgtcagcacccaggacagtggtgtctgttaaggctgccagggattagcagggaggaaagccatcaggactgggtagcctggtagcaccaaatcccaattaatgttacctgaacatgtggtgaggtcagccgtatgatgaaagatgtttaagagattaatgtcagaagaatatgaaaataaacaccggcttaaaaaatgttaaaaaaaaaaaaaaaaaaaaaaaaaaaaaaaaaaaaaacaccaccccaacaacaacaaagggggggcccccccacacaagacactccccacagggggccccacacatctcatcgacgactccacccacgcgtttgtgtcggacaaacaca

SEQ ID NO: 387688 - DNA, 4837 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
  misc_feature (4378)..(4378): n is a, c, g, or t
  misc_feature (4381)..(4381): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttataaaaaaaaaaaaaaaaaaaaaaaaaaaaaaaaaaaaaaaaaaaaaaaaaaaaaaaaaaanaanaaaaaaaaaaaaaaaaaaaaaaaaaaaaaaaaaaacaaaaaaagaaaagaggggcgcgcgccgcgcgagcaagacatcctcgcccagcagggcggcgacacactaagacccaccacccctattaatgcaacagagcaggcaccccacaacagaaagcggcgccactttcaaacataacagcgaagcagggcggccgcggacgctgaaaacacacaaacaaaagcaggcggaagggcagggagaacacacaaccggagcgacccgcgagggagacctaactctagtaggagggagagacaaaaccaccaccccccgaccgagggggggggagggagagaacaccaagaaagcggaggacgaagacacaacaaccaacacgcgaaaaaaaacaaaaacaaaaccccaccaagaggcgacagagaaataacacaacacagcgaagaagagggaatgcgg

SEQ ID NO: 387689 - DNA, 4060 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggct

SEQ ID NO: 387690 - DNA, 4250 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387691 - DNA, 1204 bp, Homo sapiens
cagctccgaccctcacacgcacttgcacggtacttctatggaagggtgagccctcacagatggagcaatggggcgcgcacacctgaacaagggaggggaaggagttcttatccctgatgcatgtgaccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttat

SEQ ID NO: 387692 - DNA, 2897 bp, Homo sapiens
  misc_feature (4)..(4): n is a, c, g, or t
  misc_feature (6)..(7): n is a, c, g, or t
  misc_feature (9)..(11): n is a, c, g, or t
  misc_feature (13)..(14): n is a, c, g, or t
  misc_feature (281)..(281): n is a, c, g, or t
attngnntnnntnnagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggnttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggtgagtgagagaacgaaagacagtccacaatgtgagctcctccccagccccaataaagaaaggatgtcatctcttc

SEQ ID NO: 387693 - DNA, 555 bp, Homo sapiens
tattagataacagattaagaattgatttttccccttaaatgttcttatacctactgtctctatacaacactttgccctctgatttgggatgccacctctattacctactatcctattactttgatctctcctaccgatagcagagcagaggaagagattgctaaggaccagaagcccaaggcaaatgatagggtaaacagggagaggtctgagggcaggagggactcacagaggggaggaggcctgaatatgagtcccatggccattgagatgagctaagtctttcacactgtttaagcttcttatttattcggctgttgctaaaacaataaaggccctttaagaagcacccaggctggggtggctcacacctgtaatcccagcactttgagaggccaaggcgggtggatcgaggtcaggagatcgagaccatcctggctaacatggtgaaacaccgtctctactaaaaatataaaaatttagctgggcgtggtggcaggcacctgtagtcccagctactcgggaggctgaggcaggagaatggcgtgaacccgg

SEQ ID NO: 387694 - DNA, 660 bp, Homo sapiens
  misc_feature (598)..(598): n is a, c, g, or t
  misc_feature (623)..(623): n is a, c, g, or t
  misc_feature (637)..(637): n is a, c, g, or t
tgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgacttatctcagggctatgatagctcagaaagggacttctcactcattgatgatcctatgatgccagctaactcagactccagtgaagatgctgatgactgaagccccagcatgggcccccattgcttggggcggctgctgttattttcatttactctgggcccttgggantatgggaaacgtggggagggggcangggagatgtggggngaagttccagggattcccagggg

SEQ ID NO: 387695 - DNA, 430 bp, Homo sapiens
actggaagatagttgttacatactgaagtaggttattaaataaagtaatgaaatatctttgaacatatatataaataggacaggcttatattctaactagtttgcggtgttttcagctaactctatcacacctaaccatctgtgtaagacttgatgcattttatatcatttttaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccaggtaaaacattctacttgtgttcagtagatattgggtatttttcttcagtttttataacacactttaggcacacctcaagcaaagaccaagtaaggcagcaaggggtggattcaaac

SEQ ID NO: 387696 - DNA, 459 bp, Homo sapiens
ggaagatagttgttacatactgaagtaggttattaaataaagtaatgaaatatctttgaacatatatataaataggacaggcttatattctaactagtttgcggtgttttcagctaactctatcacacctaaccatctgtgtaagacttgatgcattttatatcatttttaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccaggtaaaacattctacttgtgttcagtagatattgggtatttttcttcagtttttataacacactttaggcacacctcaagcaaagaccaagtaaggcagcaaggggtggattcaaacataatgactctccaggttgcatgaggtgtttt

SEQ ID NO: 387697 - DNA, 2523 bp, Homo sapiens
tgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaaaaaaaatg

SEQ ID NO: 387698 - DNA, 2290 bp, Homo sapiens
tgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaaaaaaaatg

SEQ ID NO: 387699 - DNA, 2461 bp, Homo sapiens
tgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaaaaaaaatg

SEQ ID NO: 387700 - DNA, 757 bp, Homo sapiens
acagctgaaaaactcaagatctgtccaaagcagatccacatgtagacatcaccaagggtatcaatagacacaaccacagaggtgtctgcagtgtgcatcatgaagtccagcccctaactttagaccaacttcccagtctggaaggaaatttccttagaggatgccagtgctagtggcatcagccacgactcaggtgcagccatggagtggtccagcatgttactgtaagcagccagagggcagaggaaaggagcaagaaagatgagagggagggtggcaacatcatgggtgggcccctactggtatatctcactaccctacagtggcctgggggacacaaagaacacgatattttgatgggcagaggctctctcaggccagagcagtaggacttggaaagaaactgaagccaagctgaggaatgaggtttcctgtttcaatttgaccactcgtggctgtggatcccaggatatcacaaattgcaatgcctttcccattttctctgtggctgcaaacacttgggtcaggctctcattgacctggcgcccttgaggcacttaataaagcctattacttgaaactgataatacattagcactttatttactatgactttcaatgaagtattgttctccagtattgaaaataggaaaacgattaacaagagcttgatagttacgtgaataaacaatggttgatcctaaagaacaattaggcagcacttgataataaacagttggtatttcatgtatgctca

SEQ ID NO: 387701 - DNA, 506 bp, Homo sapiens
tttgcaggagagtgtgcggggaaggaaccgtgtcctccttcagccactgtgagcctctgggtttgggatctgtgtttctgtcccccaggtctctcctgtgactctgagtctgcctgtctgttgctcagattggctgtcccagaaacacaactgtgcacctcccacctctcctttcagaatggaaactgaggcccagatgggatgggactgggctaaggtcattcagcggggctggagtgagtgggcaaggttgatctgattctgtcttttccttacctgtcatctgcctttcctggttgctggctctctggttgctcattcatttattcagtcagccagccagccattcagtcatttgaagaccaaagactttgtctaatccacgtgtgtgtgtgtgtgtgtgtgtgtgtgtgtgtgtgtatgagcgcacacgtgcatgcatgcacaccagtgtgacgtgtctttcagtttctgtgggtccatctttttccttgtctcttagtgtc

SEQ ID NO: 387702 - DNA, 1049 bp, Homo sapiens
cagccccacagggcaccagcctgtgtgagcacccagcagacgccgctgcactgaaccctgaggactttctttcctcttcttcttggatatattagctcataattccaagtgttggataaggttgtggtaaatcttttaaaaattctctcaaaaagcaatatagtcaatggttacgtgataatgatcatgcatttactcccaaaaagaataagacagctgttgtattgttagagcatgtgcctgcagctggggacacgcttttcagtgtctgcatcacacacacactgaagtgcctccaacaagtatgtggaagggcccatcacgtgccctcgatggcccaggaaggggccagtgctgatggagacacagccccaaggcactcatggtgagtctgctgttctgtgacactggggtgtaggggagggaaaagcaacatgaacctgtaaatgcacaactggctatctgctataatgtgggaattttttaattatgtgcaacaaaattagtaaatgaaatactgtaagtagacaatgtcacctatatctctaaaaactgacacattcaaattggcctgatcacctcttcgaacttccccctttggggtggcccttatccctggactccaggagggaggggtcctggacaggctgcgccaccccctcacccctcctccccacacttacctgaggaacagcccttccaggtggctgcgtggcttcaggagtgaggagtccaggatgcatggcagggggtgacacctgggcagaaacacagtctcacctggatggaccggcgggatggtctgcagggacactgagtacttttccaccagcatcctggcaaggcaaggggcaggagggccgggcatcagcagatgcacctcggcctgaggcatggccattagcccagggaaggatagaggggggccacgggctccctgccttgcagtccttgcggcaaaccaaggggacagcgccacctgctgatggaggaagagcccacctaggcacgcaggagcccttcagtctcccatcaataaggcctatccc

SEQ ID NO: 387703 - DNA, 311 bp, Homo sapiens
ccactgtgccctgcccctgctaatttttgtattttttgtagagatgagttttcaccttattgccctggctgatcttgaactcctggtctcaaatggtcttccctccttggccacccaaagtgctgggattccaggtgtgagccactatgcccagctggagcttaatttttaagacaggcctgccttgttgataaataaggaactacaaattaaaacaaaatgatttgttaatggctcctggggtacagggttctgggagaagttcttcactttctgcttgatacacttttgtagtatttgcattttcatag

SEQ ID NO: 387704 - DNA, 417 bp, Homo sapiens
ctgtgctttggggcaatacttttgtagtattatgttggatggaatgacatgggaaaaggctggcaggagggagaccagatagactctattgtcaaagtaggggaaagatggaaagaggcagtgggaggcaagaagggaacacacctaagaggtggtgtgcgggaattatctgaggagcttgaacagtcactggaaagtgaggaagggaaaagggaggccaaaagatcattgtcaggcttagctgagagagcagttgggtcattttcagaaagaagatataacagaggataaggaagaggagagaagtttctttttgagcatgacaggcttgtccaagttaagggactagaatacagagggaggttagagctaccaggagatttgtaggtcatctgcttaggagcgattttcatatcc

SEQ ID NO: 387705 - DNA, 1151 bp, Homo sapiens
gtatgctgttctagaggatccctcataggttcgaggtcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387706 - DNA, 495 bp, Homo sapiens
  misc_feature (13)..(13): n is a, c, g, or t
  misc_feature (16)..(18): n is a, c, g, or t
ccccccccccccncannncattaggctaggtacgaggctgggtgtgaatcggccgaggccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggagatcgcaggagccacaaaaagaaaaacagaacacaaacacaaaaacacaaaccaacaaacaacaacacacaaaaacacaaacaagaagcaaaaaaaaacaccacaaaccacacacacaacaaccacaacaacaccaacacacacacaacaaaaccaccaaacacacaacacaaaaaccacaacaacaaacacaaacaaaaca

SEQ ID NO: 387707 - DNA, 2256 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387708 - DNA, 2233 bp, Homo sapiens
acttaggctcaagtacgaggccgcgtgtttcattcggccgaggactgctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387709 - DNA, 2608 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtgatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387710 - DNA, 2213 bp, Homo sapiens
  misc_feature (13)..(13): n is a, c, g, or t
  misc_feature (16)..(18): n is a, c, g, or t
ccccccccccccncannncattaggctaggtacgaggctgggtgtgaatcggccgaggccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387711 - DNA, 2208 bp, Homo sapiens
aattatcgggctcgggtttgttgctgttcctgtgcgttggcgtcaatttcacaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387712 - DNA, 2184 bp, Homo sapiens
ggccgtggttaatcggccgaggaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387713 - DNA, 2564 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387714 - DNA, 2440 bp, Homo sapiens
ttttatatgaaaggttccatttgtgtttctgtataaaggcttttatcctgtaaggaaaaaaaaaaaacacaaaaccctagaacataataaatgccggttttctacaaaaacaatggtctaactctggggtgggactgatctcttctcaacagcccagggcagggctgggtccctcattcacctggtgtccacagggccgaagacactgcacacactaggacaggatttggattggaatttaaatcctgccacccaccaaggagacctcgcccacgcgtccgtatggaatgggatcaatggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387715 - DNA, 2434 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggagcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387716 - DNA, 3093 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttccttgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387717 - DNA, 1598 bp, Homo sapiens
  misc_feature (1551)..(1552): n is a, c, g, or t
  misc_feature (1556)..(1556): n is a, c, g, or t
  misc_feature (1562)..(1562): n is a, c, g, or t
  misc_feature (1564)..(1564): n is a, c, g, or t
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctgganntgtnagcgcngnagttgtgattcctccataagatcgcggggtgaag

SEQ ID NO: 387718 - DNA, 1842 bp, Homo sapiens
  misc_feature (1842)..(1842): n is a, c, g, or t
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtcactctccttccgaccaagaatatccaccggtcagacaacggggactcgggtcaatggcaccctgggggaagagcgtggcatatgtcggtccacaacttcgcatgctaggggtgtatccatcacgtcacatgttagtcccagacaacgatggcgcaagatagagcacacagtgctacgatgggtgtgaagagacaaagcaagaacagcgaacccctgtaactgaattcgtttagtgatcccttcccggtctcgcgcccgtctactgn

SEQ ID NO: 387719 - DNA, 2560 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387720 - DNA, 2873 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctgatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggacttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387721 - DNA, 2677 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttccttgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387722 - DNA, 1668 bp, Homo sapiens
cctccccccctccccctcaacctaccgtctcgaacataggtaggtcgaggctgttctaaaagaggaagacagtaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387723 - DNA, 1738 bp, Homo sapiens
ggtgtcacccgcaaaccccctcacttgtatctttcagtgttttgaggacctgtgttcagtcaggacctcttgattctgagtatgagctgtggggagggaggggatcatcccagtctcagcagtctgggatcctccccctggcagggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387724 - DNA, 1779 bp, Homo sapiens
gaggagaagaagaagcagctggtcagacaggtgcgggagatggaggcagagctggaggacgagaggaagcagcgctcgatggcagtgaccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387725 - DNA, 1287 bp, Homo sapiens
agttcgacggagactctcccatccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387726 - DNA, 1227 bp, Homo sapiens
cgcagccatggaagttgtagatttcattcaatcaaagatctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387727 - DNA, 1391 bp, Homo sapiens
  misc_feature (1391)..(1391): n is a, c, g, or t
ggccgtggttaatcggccgaggaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtcactctccttccgaccaagaatatccaccggtcagacaacggggactcgggtcaatggcaccctgggggaagagcgtggcatatgtcggtccacaacttcgcatgctaggggtgtatccatcacgtcacatgttagtcccagacaacgatggcgcaagatagagcacacagtgctacgatgggtgtgaagagacaaagcaagaacagcgaacccctgtaactgaattcgtttagtgatcccttcccggtctcgcgcccgtctactgn

SEQ ID NO: 387728 - DNA, 899 bp, Homo sapiens
atttccccgggaccgagtatgccatgtttcgattctcgagcggggctccccatggaatacgcgtatgaggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387729 - DNA, 1057 bp, Homo sapiens
tcctcagtctcactccgataacatagaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387730 - DNA, 987 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387731 - DNA, 1617 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttccttgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387732 - DNA, 1078 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgccgtagtcagtcttgcggcagtgggtgatcacaaaggggcggaaaaaggaacgggggaagcggagaaagaggacgggaggggggataggacgagggacgggtgagggaaacaacaatggtcggagcaagagccagacgggggaaaatgaaaaaaggggggaaaaaggaaaggggagcataacatggtg

SEQ ID NO: 387733 - DNA, 1727 bp, Homo sapiens
  misc_feature (1261)..(1261): n is a, c, g, or t
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttccttgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctctaaaaaaaaaaaaaaaaaaaanaaaaaaaaaaaaaaaaaggggggggccgcgcgggcccataaaatttattcccccgcgggggggcccccgggtttcggcgcgcgttacccccgtttttttgtggtccaagggggccccctatatagggggggggcgcgtatatatatataaagccgagggggccggggcccgcgccgggtttaacacacggttcgcgggggcggggggaaaaaagcgggctaccgtggggaactcttgtggggagaggaggacccctaactctgcggggggcgggtggacattatcgtggggaccaaacttcccttaccggagagattttaagcgccccctgggggaacttattacaactttttcaggggtttatacgtgtgtttacccacacgcggcattatgcgtgcccgctggacgagtgtgcctaccggggttgtgctttgtgcaacattttttcccgggatttttctaaaga

SEQ ID NO: 387734 - DNA, 642 bp, Homo sapiens
cagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttt

SEQ ID NO: 387735 - DNA, 885 bp, Homo sapiens
  misc_feature (13)..(13): n is a, c, g, or t
  misc_feature (16)..(18): n is a, c, g, or t
ccccccccccccncannncattaggctaggtacgaggctgggtgtgaatcggccgaggctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggtaactttaacagatcatattggtaacattctaggaccccaattccagacgttccagggcaagaacaggtccctttgttcatttactttccagggtctggccctcattatcatttcctgcgtggtgctgtttttctgtattctgtcattcttttttcccagtaggtactgtattggtttataatctcaccaggacttgttttaatccaaagagcctctatctttttttatttttattttttaaaatttttaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgg

SEQ ID NO: 387736 - DNA, 2635 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387737 - DNA, 2707 bp, Homo sapiens
  misc_feature (2279)..(2279): n is a, c, g, or t
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctctaaaaaaaaaaaaaaaaaaaanaaaaaaaaattttggggccctggccagaagaaaggttttacaacccaatcgtttggggcacgcgaggcccccagtaaggtaagctgacaccttggtggcataagggtgggacgcaaaggaaaggaccggcgggcacaagaacaatctgcggtgggatcctccccccagaataaaaaaaaaagcgccgggggaacacaaccgtagactgtttattagaaacaaaacccagacaaagatggcgcgactccgacgagcacacaacagggtcggaccatcaacaacaaggaggacgatacaagagagcgaagctgggaaaatcaaaattaaacgacccgcgatgcgggggatcaataacacgaccagacgagaaacacgaagacaacaacacacactaacgacagacacaaagagacacagaagcacactgc

SEQ ID NO: 387738 - DNA, 2189 bp, Homo sapiens
aaaacttacggctaggtagcgaggctgggtggtgccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387739 - DNA, 2213 bp, Homo sapiens
taatttcatatgggacggcgttttattgacttagttgccgtagcttctgacattgacaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387740 - DNA, 2582 bp, Homo sapiens
aggatccttaattaaattattcttccccccccgcgcttccgctccctcacagctcccgtcccgttaccgcctcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387741 - DNA, 2478 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccaggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387742 - DNA, 1905 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagaggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387743 - DNA, 1807 bp, Homo sapiens
acaggctagtcaggccggggtgaatcggccgaggcccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387744 - DNA, 1557 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattgggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 387745 - DNA, 1772 bp, Homo sapiens
attagctaggtagagcctggttgatcggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387746 - DNA, 1647 bp, Homo sapiens
aaaacttacggctaggtagcgaggctgggtggtgaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387747 - DNA, 1094 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgagaatgcagcgcgtaagggccagcacgcgcgtaaggcgcgctaaggtcagcagt

SEQ ID NO: 387748 - DNA, 1007 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttgtgaccggctccctgtgaggggcttctgcttaacctgaaagtgctcaatgtaacagtttggaacgcagaacacaagggagaagagagaacgcgggaagtacagggaaaa

SEQ ID NO: 387749 - DNA, 1393 bp, Homo sapiens
ccggcacaagcgtggaaagccgagccccaggtgatctgccaggcgcgatgtaggtcagcacgaaacgcagcttgtacagcacgtcccacagcttgctgaaagcagggacatgaggaagtagtcaagcagaaagccctgggagaggcgcgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgc

SEQ ID NO: 387750 - DNA, 868 bp, Homo sapiens
aggatccttaattaaattattcttccccccccgcgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaggaaatcttcaagaattgccaagcagacaaaaggatctcaatcgacgtgatgggcatt

SEQ ID NO: 387751 - DNA, 934 bp, Homo sapiens
  misc_feature (241)..(241): n is a, c, g, or t
  misc_feature (255)..(255): n is a, c, g, or t
  misc_feature (261)..(261): n is a, c, g, or t
aaaccccccaattgtctttaaagcccttggaaaaatccccggggtattccaggattttttggccaaaagccctttcccatttaattcttccccactaatggctttcaccaaacaatttagactttaagtgcagtactcttttaattacccccgccccaaatttgggttccccaaaaattgaatgtttgttttcaaacgaatattaggcatttgctcgtcaaatgtggttgttaataaaccnaatgttccaacggncccccnagtatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgagaccagcctggccaacatggtgaaaccctgtctgtactaaaataacaaaaaaattagctgggcttagtggcaggtgcctgtaatcccagctacttgggaggctgaggcaggagaatcgcttgaacctggaatacagaggtttcagtgagctgagatcaccccattgcactccagcctggacaacaagagtgaaacgctatcaaagaaaaaaaaaagatgtaatccagatatatttgacagtaattaaaatcttttaaatgttataaatgca

SEQ ID NO: 387752 - DNA, 2021 bp, Homo sapiens
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387753 - DNA, 2074 bp, Homo sapiens
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgccccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387754 - DNA, 2052 bp, Homo sapiens
  misc_feature (2016)..(2016): n is a, c, g, or t
  misc_feature (2021)..(2022): n is a, c, g, or t
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaacgatgcgtccagattcctnttttnncccaccaatctcaccacctccttctcctcc

SEQ ID NO: 387755 - DNA, 1104 bp, Homo sapiens
gattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387756 - DNA, 1204 bp, Homo sapiens
atttgcctgttgtttaggcaactccttaacatgcctgtgacagctgaaacccttatacaaatcctttagctaataactacagcaggcgctatttgtgctatggaaataaagcacgattcttagatgacatttttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387757 - DNA, 2105 bp, Homo sapiens
  misc_feature (2069)..(2069): n is a, c, g, or t
  misc_feature (2074)..(2075): n is a, c, g, or t
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgccccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaacgatgcgtccagattcctnttttnncccaccaatctcaccacctccttctcctcc

SEQ ID NO: 387758 - DNA, 2070 bp, Homo sapiens
  misc_feature (2018)..(2018): n is a, c, g, or t
  misc_feature (2021)..(2022): n is a, c, g, or t
  misc_feature (2031)..(2031): n is a, c, g, or t
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaacagtgttcgcgccggcaaggncgnngcttttctntgtgtctccgccgccgcacttccccccccgccgttgata

SEQ ID NO: 387759 - DNA, 1594 bp, Homo sapiens
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgagaccagcctggccaacatggtgaaaccctgtctgtactaaaataacaaaaaaattagctgggcttagtggcaggtgcctgtaatcccagctacttgggaggctgaggcaggagaatcgcttgaacctggaatacagaggtttcagtgagctgagatcaccccattgcactccagcctggacaacaagagtgaaacgctatcaaagaaaaaaaaaagatgtaatccagatatatttgacagtaattaaaatcttttaaatgttataaatgca

SEQ ID NO: 387760 - DNA, 1918 bp, Homo sapiens
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387761 - DNA, 1790 bp, Homo sapiens
tgttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387762 - DNA, 1243 bp, Homo sapiens
ctagctggaacgactctcttaatttttccaccgctacagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatt

SEQ ID NO: 387763 - DNA, 301 bp, Homo sapiens
ctggcaaaggtggcagatggagatgcccagagtgctaccctcaactttctacaggccgcggctgcccactgcacgaactgggacctacagcagggcctgctgcgggtctgccgggcgctgctgcgggcaggggtgaggggcggcctggtcgacttgctgcaggtgctggccaggcagctggaggaccctgatgggcgtgaccacgcccgcctctactacatcctgctggcacacctggcagcacccaagttgggggtggccctgggcccctcgcttgccgcacctgcactggcctcttcac

SEQ ID NO: 387764 - DNA, 2684 bp, Homo sapiens
gctaggagagtcggtggtgaatcggccgaggggtggccgagaaccagggctttgtggcagcactgatggtgcaggaggcaccggccctggtacggctgagcctggggtcccatcgggtcaagggcccactcccagtgttgaagctccagccggaggcgctggagcccatctactctctggagctgcgcttccgtgtggaaggacagctgtatgcacccctggaggctgtccatgtgccctgcctgtgtcctggccgccctgcccgccctctgctcctgcctctgcagccccgatgcccggcccccgcacggctggatgtccatgccctttacaccacatccactggtctcacgtgccatgcccacttgccacccctgttcgtgaactttgccgacctctttctgcctttcccgcagcctccagagggggccgggctgggcttctttgaggagctctgggattcctgcctgccagagggtgctgagagtcgtgtgtggtgtccacttgggccacagggcctggagggcttggtgtcccgccacctggagccttttgtggtggtggcccagcctcctaccagctactgtgtagcaatccacctgcccccggactcaaagctgctgctgcggctggaggcggccctggcagatggagtgcctgtggccctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagagctctggaggctgggaagtccatagtggagggcccagagcccagtgaggacccttctgcatcttcccatgacagaggacagagtgacaggagtgaggggagagagcgaacccactcccaagataacggcctgagtccacgcaggagggcagagccctcgtggcctgaccacctcttagggtctaatcttatactgttacagtggcaatcgcatttcaacgtgagcgtgggaggggacaaacattcaaaccatagcagggtcataggccccaagaaggcttccagacagaacccggcactgtagagctacagagttccttctcacccagacacactagtgctctccagaatctctgcccaggaggcaggggaaaaatctcctttctgcttcccagagagggtctggccttgcccaaggccactcagtgatttaggaagaaggctgaagctagagtgtggacctgacctgttggacagtacttttctttctttttttttcggggaggggttaaagacaggatctcgctctggcgctctggagtgcagtggtgtgattagggatcattgcagactctgcctctcaggctcaggtgatcctcccatctcagcctgcctccgagtagctgggactacaggtgtgagtcaccactgtattttttgcagacaggatctccctgtttcctaggctggtctcgaactcctgggcttaaatgactcttctgcctcagcctcaccaaagtgttgggattactggtgtgagcccccacacctggccgagccagcgcttctcaactcccaaggtttgcaagctccctgccccagggagctcacgccaggcaggccagtgggcctaagccagaaacagaaagacagcagtggccaggtggagagcttcccaagctgtgccgattagagccagctctaggaagggcctgctaataaggtctagggtctgagaccaagttttttctaatctcagcccctaagaaacctaatttgtgcttaggaatcttcccaggtaagaagaactagttcctctagttgttgtttttttttcccaaacatgcaaacactgaggattgagctgtgtggggtcagctgtgctgccaggcacatgtacgttgcctcatttcatccttgcaacagctctgcagggccccgcagatgaggaaatccgtaggcaggagcggttgagtgattttcctaaggtcacccagctgtttggtaatagtgttttgtcatctggtagcaggtttccattaccatgccatcagagcagacctcagccagggccacagaggtcccaaccgtctctgccctcttctgctgcccctgcctcatgggctcccagccacaggttccccatgggccagctttacgcctcctgatccttccgattggggcagactaggagaggaaagacgggcctgggctgggtgcggtggctcatgcctgtaatcccagcactttgagaggctgaggcgggtggatcacctgaggccaggtgtttgagatcagcctggccagcatggcgaaaccctgtgtctaataaaaatacaaaaattagccgggcgtggtggcgggcgcctgtaatcccagctacttgggaggctgaggcaggagaattacttgaacctgggaggcagaagttgcagtgagccgagatcacgccactgcactccagcctgggcgacagagcaaggctctgtctc

SEQ ID NO: 387765 - DNA, 3342 bp, Homo sapiens
ggccacctccctgttggacaccttggtcctcctacccccgcgggtagcgatctggggcgaggctttgtccccgcctcggaacagcgccccttgcaggccacggcctgcgagtgcctgcgagagctagagagctgcaagcccgggctgctggggggctccctggggttgctgcggggcctgctggggcaggaaggccctgtccagccactcagcctgttgctggccctcgctttgcgcaacaccttggtgctccagtcccgggttggggctggcctggggggactgctcacggataaggtctccccaactgggggtggtccctgggattggacactagtggaggagggcgatggacgccttcagccccaggcacccagctggccggcagctgaggagggagagggggagcgtagccttacagcacgagagcacagccctgaggaggcgcgggagctgcgggctgcggtgatccagcttctggacacctcctatctgctcactcctgtggcccaggcccagctcctgtggctgctgggctgggccctgcggggtctgcagggacagccaccggcactcttcaagccgcagctggtacggctgctaggcacagcacagctgacactgttgcacgccatgcttgcgctcaaggcggcctttggtgaggccttgttcacagcccaggatgaagcgttgctgctccgccggctcaccttggctgcccagcaccctgctctgcctccgcccacccatctcttttaccttcactgcgtcctgagcttccctgagaactggccgctgggccctgaaggtgaggaggctgccccactgctgctagggccccagctatgccgtggtctcctgcccagtctcctgcatgacccaatggccctcctggcccgcctgcatttactgtgcctgctctgtgccgaggaggaagaagaggagaaaggccagcttccaagcccacggcactacctggaagagctgctggctggcttgcggcagcgggcagccctggatgggggcccccgggccttggccactctctgcttccaggcctcgtatctggtggcctgctgcctggctgggcaacctacggtgctgacccccttgatccacggactggcccagctgtaccaagcccggcccatgctggctccccactttgtggacctcttggatcaggtggactctgagctgagggagcccctgaaggtggtggcccagcctcctaccagctactgtgtagcaatccacctgcccccggactcaaagctgctgctgcggctggaggcggccctggcagatggagtgcctgtggccctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagagctctggaggctgggaagtccatagtggagggcccagagcccagtgaggacccttctgcatcttcccatgacagaggacagagtgacaggagtgaggggagagagcgaacccactcccaagataacggcctgagtccacgcaggagggcagagccctcgtggcctgaccacctcttagggtctaatcttatactgttacagtggcaatcgcatttcaacgtgagcgtgggaggggacaaacattcaaaccatagcagggtcataggccccaagaaggcttccagacagaacccggcactgtagagctacagagttccttctcacccagacacactagtgctctccagaatctctgcccaggaggcaggggaaaaatctcctttctgcttcccagagagggtctggccttgcccaaggccactcagtgatttaggaagaaggctgaagctagagtgtggacctgacctgttggacagtacttttctttctttttttttcggggaggggttaaagacaggatctcgctctggcgctctggagtgcagtggtgtgattagggatcattgcagactctgcctctcaggctcaggtgatcctcccatctcagcctgcctccgagtagctgggactacaggtgtgagtcaccactgtattttttgcagacaggatctccctgtttcctaggctggtctcgaactcctgggcttaaatgactcttctgcctcagcctcaccaaagtgttgggattactggtgtgagcccccacacctggccgagccagcgcttctcaactcccaaggtttgcaagctccctgccccagggagctcacgccaggcaggccagtgggcctaagccagaaacagaaagacagcagtggccaggtggagagcttcccaagctgtgccgattagagccagctctaggaagggcctgctaataaggtctagggtctgagaccaagttttttctaatctcagcccctaagaaacctaatttgtgcttaggaatcttcccaggtaagaagaactagttcctctagttgttgtttttttttcccaaacatgcaaacactgaggattgagctgtgtggggtcagctgtgctgccaggcacatgtacgttgcctcatttcatccttgcaacagctctgcagggccccgcagatgaggaaatccgtaggcaggagcggttgagtgattttcctaaggtcacccagctgtttggtaatagtgttttgtcatctggtagcaggtttccattaccatgccatcagagcagacctcagccagggccacagaggtcccaaccgtctctgccctcttctgctgcccctgcctcatgggctcccagccacaggttccccatgggccagctttacgcctcctgatccttccgattggggcagactaggagaggaaagacgggcctgggctgggtgcggtggctcatgcctgtaatcccagcactttgagaggctgaggcgggtggatcacctgaggccaggtgtttgagatcagcctggccagcatggcgaaaccctgtgtctaataaaaatacaaaaattagccgggcgtggtggcgggcgcctgtaatcccagctacttgggaggctgaggcaggagaattacttgaacctgggaggcagaagttgcagtgagccgagatcacgccactgcactccagcctgggcgacagagcaaggctctgtctc

SEQ ID NO: 387766 - DNA, 175 bp, Homo sapiens
ttctctgccctcaatacctgcagcacaaaaggtcataataaaagctcgttgtaaggatgactcctcagaggagtgtgctgagttgggggtaaatgtggggatggggacatgccatccctgcttctgtgtttcctccagttgtgtttctagggtgggcctgaggtgggtacagcag

SEQ ID NO: 387767 - DNA, 3611 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387768 - DNA, 562 bp, Homo sapiens
cccttgccatttactccatgggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatggagtaaatggcatgccatttactccatggcgtagccggtaacatggaatactgatccaaaca

SEQ ID NO: 387769 - DNA, 3102 bp, Homo sapiens
tctagaggatccctgagagaccgtgttgcatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387770 - DNA, 1718 bp, Homo sapiens
agtcaagtccttcttatgctttatcattctcacactgactgtcctgccgctgcctctctctttaatgagtaagaacctttgtgattacatgggccccacttggataatccagggtaacttccccattttaaattcaactgattagcaatcttaattccatattcaaccataattcctccttgccacgtaaagcaacatatttggaggttccaggaattagaacatagacgtctctctctgtgggacattattttgcctatcacagcaaggttacatggctgcctgactcttggaaagaaatcctctgattctcaaatccaatcaaatattatgtaaaaacagcacttccaatataatcttcccatcttttcaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387771 - DNA, 2978 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaagacacagtgcagacaggttcagaagaggaggaggaggaggaaggagagccagaagatacagagctgggggatgagatgactgaatgtctgacgatgcccgcccagaaacgggcctgccctagaccctgccagaaaagggggctcttcccccagagaagtggcgtggagggaacttcccactcccatccctttcgata

SEQ ID NO: 387772 - DNA, 1681 bp, Homo sapiens
tgaaagaaggcctcacacatggagcaggtgttgccatgcatttttccatctgggccctggatggggtcattctctctggtgcaaaaaagccgtccgtttttcctggatttgcggtattcactacacaactcctcaaaggaagctcgtactcttagattgtcttttgtttcttgatttaccttccttctttttcttttcttcttcttctgcttggaagaagacctcacacatggagcaggtgttgccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387773 - DNA, 1225 bp, Homo sapiens
aaacatactaacaactaaaatttactgaacacttagtatgtgacagatactgcgttaagcatgaacttacatgcattatctgttttaatcccttcaagcagtaatataaagtaaggactactattatttatgattttctggtgagaaaattaaggctgagaaaagttagataagttacttctctagttagtggtagagctaggactcaaaaactcatgcaatttatgagtatttacctctgagtctttcctttctaggctgtatataaccaataccttcacttaaaaaggcgaatattatttctggcatgcctatcattctagatttcttcttatgggcaggtaattgtgtcacatattataaaggatatttgctttcttattgctttgctactccttgtttctttgtttacttaccttgtcaagttaaaaattgccaaatacaggaagttaaatccacctcatatggtgcaaaatcaatctttgagtttgaataacatatatcacactccttttacaaccatttattcaagttggattaaggaactcaagaggttttcttaagcccacccctcttcttgaatgccataaagtacgtctgctttattttttgcttcttcaggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387774 - DNA, 276 bp, Homo sapiens
tcgcagaaatacttggttaaagacaattcagtaacaacccttgaaaaattaccctatctttttttttaattattctgcagtgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaacttcaaagaaaattgatttttc

SEQ ID NO: 387775 - DNA, 3701 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387776 - DNA, 3594 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtccttgttagcgcgtgctgtccgaagtcctct

SEQ ID NO: 387777 - DNA, 3623 bp, Homo sapiens
  misc_feature (3573)..(3573): n is a, c, g, or t
  misc_feature (3580)..(3580): n is a, c, g, or t
  misc_feature (3595)..(3595): n is a, c, g, or t
  misc_feature (3597)..(3597): n is a, c, g, or t
  misc_feature (3602)..(3602): n is a, c, g, or t
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcagaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacnatggggncgttttccccaaaancntgggngggtttcaaaaggggttcaaa

SEQ ID NO: 387778 - DNA, 2882 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtgaatcaagaaacaaaagacaatctaagagtacagcttcctttgaggagttgtgtagtgaataccgcaaatccaggaaaaacggacggcttttttgcaccagagagaatgaccccatccagggcccagatgggaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaacttatctgcactcgagaaagtgaccctgtccggggtccagatggcaagacacatggtaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatctta

SEQ ID NO: 387779 - DNA, 850 bp, Homo sapiens
cccttgccatttactccatgggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggctatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacacccaaactgggatttctttgtcactatctggataatagatatttgcttttaaagaaactgaaaaaaaactacccttttg

SEQ ID NO: 387780 - DNA, 1274 bp, Homo sapiens
tatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgatcacacaccgtctctcagggatcctctagatcagcctcggcacac

SEQ ID NO: 387781 - DNA, 81 bp, Homo sapiens
gggggaaagcattggccccaggccaaaatcataaacgctttcaattaactaataataattgctggcatgttgccattaaat

SEQ ID NO: 387782 - DNA, 321 bp, Homo sapiens
tctacataatcctttgtttaagtaatagattcaaaataaacaatagcacagttattgtaaaggcaaagaaatagaaattaaattactttaattctgctattctttgtgaccactttgaatctttgtgtttaaaactttaaaacaatgaaatagtgcaaactttaaggtataatacatgtttgatctaaaatttattcacaaaatatcttactgaatttttattttagtagaaatacattcttattcattaactattacttttttaagctaaagaacaaatttaaaaacaatttattacagagggcaaaaagcactaaccct

SEQ ID NO: 387783 - DNA, 1070 bp, Homo sapiens
acttgagttgaatcttaaaagatgtgtaggttgggggtgagatagagggaaatgggaagaacattctagaaagaggtatcggcaagaatagccaagccttggaggagacaaatagtaggaaatgttatagaaagggaagagggtgttgcctagatggagcaaaggggtgaggtgaggccatttgaacaaggctggagaagtaacggaaatcaagccagtcgagacagggattcatcactgaaaatccacttccaggacctgcacccaacacaggacctgtatatggttacataatttgaacattcccagcagtttgtcatctagtatctgagattcagggcttcagggatgctggatacttttactaacatattctatggtgttttatataggtcctggcaagattaacattattattttctatgatgacaaataactaatacgaaatgaggatccgtttgatctttcatataaggtctagagaatgtttcttcacagttaccccagacctttggtatagcatctgtttttcagttctaatgcaaaagtatgttactgagattgaatattaactactggtaatattcattccaaatacctgtcctcatgtcaccttccacctattgcgggaggttagcccattgagggtcctctcacagtgtctcgtcctgtcgttcctgtcgtggatgtcggagtcgtcgtgggactgcgactcgtttcgtctgatgctctttgtgtttcagatgcggacgcttcagtgggtagtcccggactcgagcgggcagtgtttctcgaagttgtcccctctcacaatctccctcttcacgggggtggacgaggagtcaaggtcggactgggggagggtaggaaaccggagactgggaaaaaggtgtcccctggatggggataacgccaggaggtcgagtagaaggtggagtggggggaggaggagggaccgaaattaatacgattacaacctcctcttacttatttatttcacttagaaatttttttttttttttttttttcgaacaattttcatcaaatttcttttttttatcttttaagtt

SEQ ID NO: 387784 - DNA, 368 bp, Homo sapiens
tacttcgtctccatgaatttgcccattctagacacctcgtacaggtagagtcatacctccttccatagctgaagcattgcacttagcataatgtcctcaagttcatccatgttgtagcatgggtcagattttattttattttatttatttatgagacggaggcaacaaagcccaggctggagtgcagtggcgcgatcttggctcactgcaacttccgcccccctgggcgtggtggcaagtgcctgtagtcccagctactcaggaggctgaggcacgagaatcatttgaacccaggaggcagagattgcagcaagctgagatcacgccactgtactccagcctgggtgactgagcaagaccccatctca

SEQ ID NO: 387785 - DNA, 306 bp, Homo sapiens
ttttctgttgctaatgtaaattatacttctctatccatttttaaaaagcttttatttttgcattttataactggtcaccttcctaaacctttattatttctaataacttctcaattaactgagttttctcattaattttatttccacgtattgataattttgtccctgttttgtcattctttctatatctcctttgtatcaactgtattgactagcatattggtaaaatcttaaataggcaccctaattatctcaatgtttcaccactgctgatgctttatgtttttcatgttaaggaagcatcct

SEQ ID NO: 387786 - DNA, 372 bp, Homo sapiens
gaaatgtttaacttacatagcaatggaaatatattttcattggctgtggtaataaacaacattttccatattgtttaattgcacaaattttcacagaaatatatgaatgtatactcactcaatattaccagtattgtcttgtgtttctaggaattttagagtttccttttaaaaatggacactacacccatgaatgaatgtttattgagttcaacaaattttctaaagaacaatattcttaacttttcctctctattatcttagttttgtcttctttaaccaggaaaccctgagaagattataattcactgaagcagtaaaatatcagattatgtgtatttgatggagttgctgtgactgaaaattgccttt

SEQ ID NO: 387787 - DNA, 414 bp, Homo sapiens
tgttttttaaacggtatgcatatcagtgtatctgaaaaccgccaccttctaacatttaaggtagtagacagtatatacagatttgaaccttgctttttcacataatagatagttgaggtcattccatagcagtacacagaaactcatctttggtcttaaaactgcataggtactttagtcctctgttgacaaatgttgggttgtttcagtcttctgctatcacaaataatgctgcaaagaatacatttgttcatatgtcatttcatccttggcaattttgcctctggaaagttcctagaagtcagattcccaggtcaaaggttaaatgcgcatgtaattttgctggatattgttaaatccccctacagagcatgcaccactcagcattcccctcagcgttgtatgagagggacc

SEQ ID NO: 387788 - DNA, 216 bp, Homo sapiens
agctgactcttttgtaataaagagctggaacaaattgatggttctttatgactagatgtgccacatactctgtaactaagttaaattgcatgcggtttcttctcttggaactaggaaacctgtctcacatctcctcattacttttattaacagctgactttagtctcaaagcttctttgcttactgagaaaagactgcatgcaccaaaattaataa

SEQ ID NO: 387789 - DNA, 490 bp, Homo sapiens
cagggtttcattctgtcaccaaggctggagtgcagtggcgtgatcttggttcactgcaacctctccctcccggactcaagccatccccctgcctctgtctcctgagtagctggaattatagatgtacaccaccacacctgactagttttttaattttttgtgaagacggagttttgcagtgttgcctgggctggtctcaactcctgggctcaagaaatccacctgcctctgcctcccaaagtgctgggattacagatgtgagccaccgtgccagccttagttaataattctttactctgttcaaagaactggtgtgggtattgtctccttattgaacctgactgataatggacaggccttgagcccccaagttgctgaggcccttatggtaaccacatgtgttattttgttttagttaacagtgtacacagagacatgaggaaattgtaaagttgattttaaatcaactttaaatcaataaagttgattt

SEQ ID NO: 387790 - DNA, 115 bp, Homo sapiens
agcgagactctatctaaaaagaaaaaaaaagtaactttggaaaataggattttgatggataccgtaagtaagtttaaagacaaaaagaactggacagaatactggagatcaagct

SEQ ID NO: 387791 - DNA, 396 bp, Homo sapiens
tggccggtgagaacggcagcattccctgatccgtcttgttttcttttgttcctagtgcctgctgtgtggacagctacactcagcaaagtcttagggagacttagaggagtcaccatgaagaatcagtgtcagacgtttcatcaggaatccctgtcaaggccgggtgtggtggctcacacccgtaatcccaagactttaggaggctgaggtgggtggattgtttgaggccaggagtttgagagcagcctgggcagcacagggagactccatctccacaaaaaaatagtgaagaacccctgtcgtgtgtaaaacacgagtatcaaaaaacaaactcaacctagcatgaagtatttaacattctctctccatcccctttctctctccactcccgggtac

SEQ ID NO: 387792 - DNA, 376 bp, Homo sapiens
gtgacagagagagaccctgtctctcccaccaccacaaaaaaacaaaacaaaacaaaaataggcatttttctgtaactttaatcagcatctttgcttgctaaaattgccattcttatttagaaaccttatgcattcatgatcccactaactttactaaaacttacttttactgaaacatctagtaaactctcaagaatctatgcaacttagtaagggaaaaaaaaaccacctttgaaaagttctagatcagtataggccaatggaagaaatattgagtagtggccaggcgcagtggctcacacatgtaaccctagcactttgggaggaccaggcaggtggatcacctgaggtcaggagtttgagaccagcctggcca

SEQ ID NO: 387793 - DNA, 295 bp, Homo sapiens
aatctatatgtgtcctgttcctcccatctaccatatttatgacccaagaagttttggtaccatttaaaattgtatcttcatcctagtctaagacaaaaatctggataagatagagccaaggatagattatttatgataatcttagaaagtcatctctagagtgaaataaaatttaatcaccactggaaaaagttataaaattaattatgaatactgataatcataatgccaccccgcctatatttttctacttgttcacaaagagattatgggagagcagaccaaaaattttgct

SEQ ID NO: 387794 - DNA, 426 bp, Homo sapiens
gcacctgtcctgttcttgataccttaacctatgacatgatccggacttcagccctaagagatctgggtccatggccttcatgtccttctaagactagggtgctgcattcattcatttaccttcaattgttggcaagggagtaccaacaagtagccaagtagttcacctctgtgccaaacatattgacaactatgatttgtttctacccatagaacacttcttttttagacatgagatctcccaggctgaagttcgaatgcagtgatgcgatcacagctccctgcggccttgaactcctggcctcaagctgtcctcccacctcagcctcctgagtagacaggataacaagttcatgccaccatgcccagctaactaaaaaaatacattttttagagacagggtcctgctatactacccaggcttttc

SEQ ID NO: 387795 - DNA, 227 bp, Homo sapiens
ttggccagactggtctcgaactcctggcctcaagcaatcctcccacctcggcctcccaaagtgctgggattacaggcgtgaccttcatgcccagcccaattttaaaaattggattgagactattgttttgcagtaagacctgaagttaacaaatctttactgagcatctactcaatgaaaaaccatgataattctttgtatataaaataaacatttgaaaaaacaaa

SEQ ID NO: 387796 - DNA, 113 bp, Homo sapiens
tcagcacctgccatggagtagatgttcgataaataggactgacctgagaccttctaattgaatggcattcattcgactgttctttactgaagccgcgtaccccagtcactgtg

SEQ ID NO: 387797 - DNA, 239 bp, Homo sapiens
ctgaaacagaaaaattttatttgcctacattgtaccaaaccttagaattttctccaacttcttcaaagagcccaaaagaacaaagacaaccatacacgcatgcacatgtaaacacacaatgaaagagaaagaaacataagtcaaaatatagcaggattccttaagaagtttttgtttttatctttttctttttaattatgaaatattccttaaaagaaaacaattttttcaagttactt

SEQ ID NO: 387798 - DNA, 740 bp, Homo sapiens
cactgaggcatatgttatcccactttaaatatttagtgcctactgaatcagaaaatataatataaaggatgtctcacttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaagtatgtatatggaattcttctctttattgttttgcacttcctccttcattaatggctcataaaggaggttgaattacatgaatgtagtgaaaaaaatcttaatttaatcaacagaatgaagtgagatactgagggcaaatttgggcagaaagtattgatgagcattctacgggtcatggaaaagtggaagatgtggccatcatccttaaggatactggaaaatgtgcacaaattacagcaccctaaaaatataaggctttgtgcaataggtatcaaaggagttgaagtcgggataag

SEQ ID NO: 387799 - DNA, 5708 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttcaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387800 - DNA, 5255 bp, Homo sapiens
cactgaggcatatgttatcccactttaaatatttagtgcctactgaatcagaaaatataatataaaggatgtctcacttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387801 - DNA, 4718 bp, Homo sapiens
aaattaaccctttgctgaccacttactgctgcaggaaaggatttgaggaaccatgatgcctaactgccttggctggttattttagacataatggtttgctattgtgtttgcccagagattctgtcctgagaagattgaggagcaaaggctttcattcagatgtcacctttgtgataaccacagaggctaaggaaaaagtacttaccctctgccagacattgctctcagatgacaatgctgtgctatactattttactagtgagggatagaggcactgggaagctgagtaaagtgacacagttaggaagtggtagatctgagatgtggatataggctatctaattccagatcctgccaaaattatccataacctttgtgcagcactgcatcctcacagttcgtggaggtgggagccaccagtttgagaggttcatgtttctattgactcctggagactttttcttgcagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387802 - DNA, 5582 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387803 - DNA, 3684 bp, Homo sapiens
ctttgcttctcacccctgcctctaggcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387804 - DNA, 3758 bp, Homo sapiens
ctgctttgcactgtgggatcttgggcaagtgacctaacctttcagaacctcagttatctcctctgtaaaacagataagggcacctctctcaaaccatggtggtgaggattaaaggagataatggttaagcacggaaaacattgcctgccacaatgagtgtcacgtctttgtcattgttcttcttcccagtattattatcatgctctgggtcagatgaaatctagataagaacttggcttttcctaccagaggctagttttcggggccataagaaaagtctagaagacctgatagactggaatggaagtttcttgggaggtgaggccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387805 - DNA, 2567 bp, Homo sapiens
ggcaggtacgaggccgggtggtgaatcggccgatgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387806 - DNA, 6138 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaaaaaaaaaaaaaaaaaaaacggggggaatatattgggggggggaaaaagggttataaaggggacccaagggtccaatggtgttccccggccccacgtttcgttgacaaaggggggaaaaagtgcgcgggaccccccaatagagagagcgaataatccggaaaaccccaggctaaccggttagacgcctctcaacgaacagaccatagacaaacaaagaacaagcgcaacagacagcggaggcagcagacataaaacagaagaagacaacaacgcactacaagcagcagagagccgcagagacaagcaagcgaagaaaacgaacacaacacagtagaacaaacgaacacaacaaacaagacacaacagacgacggaca

SEQ ID NO: 387807 - DNA, 5787 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaataccaacattgttctccagtcttct

SEQ ID NO: 387808 - DNA, 1394 bp, Homo sapiens
tgtcccatggtggacggcccctccgcagcgtctgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387809 - DNA, 1397 bp, Homo sapiens
tctctagaggcacccctccccgtacgcccaaaaagtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387810 - DNA, 1321 bp, Homo sapiens
ggttgcagtaccagccacagccagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387811 - DNA, 1051 bp, Homo sapiens
gcggaggtcgatctagaggtccccgtctggagcaatctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387812 - DNA, 4992 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387813 - DNA, 1828 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387814 - DNA, 566 bp, Homo sapiens
cattcagctcggacccactttcagagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387815 - DNA, 3781 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387816 - DNA, 3878 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387817 - DNA, 3635 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaaccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaataccaacattgttctccagtcttct

SEQ ID NO: 387818 - DNA, 3338 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagcgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaaccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387819 - DNA, 3093 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagcggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccag

SEQ ID NO: 387820 - DNA, 2956 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagcgtcccctacaagtaaattttgtttctttgaacgtttattaaaatgccaagacccaaccatttcttccacctgcttgattgtgccag

SEQ ID NO: 387821 - DNA, 1788 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaatgtagtcttagggtgagccatcaatgccagcctcgggtagatggaaccattatgggcagaccgggcagggggattgggaattccacccggagcgccaatatccggaataccctgtggccgggggaaggcgatgggagccggcctaagcgaac

SEQ ID NO: 387822 - DNA, 5762 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387823 - DNA, 5367 bp, Homo sapiens
cactgtggctcggcgcacgctgccggcggctgccctttccgcctctggggaagaaaaacccgcgggccgctttcgtgcttgaaccatggcctcgggccggaggggctgggacagctcccacgaagacgatctgcccgtgtacctggccaggccgggcaccacggaccaggtcccgcggcagaaatacggcggcatgttctgcaacgtggagggcgccttcgagagcaagacgctggatttcgatgccctcagcgtggggcagcggggcgcgaagactcctcggagcggccagggcagcgaccgaggatcggggagtcggcccgggatcgagggggacaccccgcgcaggggccaaggccgggaagagagcagggagcccgcgcccgcctcccccgcccccgccggggtagagatccggagcgccaccggcaaagaggtgttgcagaacctcggccccaaggacaagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387824 - DNA, 4768 bp, Homo sapiens
agagagatgtacgaggcggtcccggttgttatttcatgcagggccggggtcttgatgttataatacatggacctgagcgacgacaatatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387825 - DNA, 4056 bp, Homo sapiens
cctcacagtaaacacaagactctaagctcccagtgtgcctccagccatctcccctgttcatgtggagcttttctcctttgccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387826 - DNA, 5998 bp, Homo sapiens
  misc_feature (5795)..(5795): n is a, c, g, or t
  misc_feature (5891)..(5891): n is a, c, g, or t
  misc_feature (5895)..(5895): n is a, c, g, or t
  misc_feature (5900)..(5900): n is a, c, g, or t
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaattaaaacaggagaaatctggtaagttgttaggnttctaaattccttttagtctgttcactgagatattaaatttcagtagacagaacccaaaaagagatttcatttctttctaatcactttggcttctntctnttttnttaagtaggtaaaaaccttccttggtgggcacctaagcaggatgcagccaattagttcatgaacccagctgcggacgtgaaggcttaaaatctaagga

SEQ ID NO: 387827 - DNA, 4896 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaaccgtcgattcgagggatcctctaggtcagccctc

SEQ ID NO: 387828 - DNA, 4730 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcgaatccccgcacaaatcaagcttatcgatacaaacgacctcgaggggggatccggatttcac

SEQ ID NO: 387829 - DNA, 3228 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccag

SEQ ID NO: 387830 - DNA, 3610 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaaccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387831 - DNA, 3180 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 387832 - DNA, 3042 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcataggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccag

SEQ ID NO: 387833 - DNA, 1443 bp, Homo sapiens
cgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaacaattgagacatcgattttttggggggtttttttcccccctggggaggagttgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagcttgcagtgagccgagatcgcgccactgcactccagcctgggcgacagagcgagactccgtctca

SEQ ID NO: 387834 - DNA, 596 bp, Homo sapiens
ctgacgagctcggattttaagacactagcctgccgatgctcccagctgattaaagccactcccttccctatctcggtgtctgaggggttttgtctgtggcttgtactgctacagtggctcaagaacccaactggacaaataaaataagcaaacaatttcattttagagataaaattaaaaaaaaaaaaaaaaaaaaaaaaaaaaaaaaaacaaaaaacaaaaaaaaaaaaaaaaaaaagaagaaaaaagaaagaagaggagcggggggcggcgccgcgaagaagaatctccctcctcggaggaggccgccacagcagtagcgcaccaccccgacgtttgttgtgaaaaagggggcgccgccccaaaaggggcgagcgattatatataaatagccaccacacgaacacgggcgcgcgcgcggggtttatcatcaacgaggcgagaggtgggagaaaaacacaggcacggagaagcaacttttgagaagaagagacccctactttcgggggggggaacgaaaatatgggggaaaacaccacctcgaagaagaattaatacacgcccgagacgaaaataaaaaacgagagcgataaagg

SEQ ID NO: 387835 - DNA, 629 bp, Homo sapiens
ggcaactgaccctgtgggccccatctggacaggagggaggcctgtcctaggagagcagggacagcacagtcccctcccgtgggtgctcggaagagaagagaggaccctgcagagaaaagcaaacgtccctgtcacagaggctggacagctggctctgttaagccctctccggggtttttccagcacacgccaggggatctccagagatggtatcgctgaaccgccccgatccgctgccagaggagtcaagagccccgtgaggggtgccgggggccctgccctggctggcgaggcccactaaggagcaagagctcccgggacacagctgccagccacgtgccaacctgagggtcccatcgcaagggtgactgtgggaaactggcaccgatgctcttcccgaaatccaccctgctggccttcccgagtgcagctgtgggtcctgggtccccctgtgttccgtccactcatgatggacagatgctagtacaggatgagcagctacggaaaaggctcccaggccaggtgcagtggctcacgcctgtaatcccagcactgtgggaggccgaggtgggtggatcacgaggtcaggagttcaagactagcctgcgcaagatggagaaaccctgttt

SEQ ID NO: 387836 - DNA, 1000 bp, Homo sapiens
ttgagacagagtctctctctataggcccggctggaatgcagtgagtggtgtgatcacggcttactgccgcctccatctcccaggctcaagcaatcctcccacctcagccacccaagtcctgggaatatatgcgtacagcacgatgcccagctaatttcttaaatgtattttttgtagagacagggtctcactatgttgcccaggctggtctcaaactcctgggctcaagcagtcctcctgcctcagcctcccaatgtgctgggattacaggcatgagtcgctgcacctagtttaattatcccattttctgataaaaagtttttcctattatatttgcaatttatactatcaatgaatagtacaataaaatttcaaagctatgagggaactcagaaatgagtaacttgagaactaagttatatttctatcattttgaacgctactgctattatgctgatatttttcatcttaccagaaaaatgaaattaaaagcatattgttttatattgaattttttattttatttttatgctggcctcattttgaaaagttagtacaattttctttagtgctaacttgtataacatatgtaaaatttctttctccttttaaaatctgtcccacttgaatacgttctcatttaattaaaaaggtaatctataacagaaacccctttggttgtcatatcttttgttgacaatagagatggtctggatctctttatatctccaaaagttgggagactggctggtgtacagcaggcatataaataatgactgaccaggataatgatgcaattattcagcaagcattttcttacacgctctgatgtttcaggcactgtactatgtagtaaggactcaaagtggatcaagacatgcatccagacctcacagagctcctacaggaacagaggagacagatcgctcacgtgtgacaagttgctgtgacagagatacctgaaagggttagggaagcaccaagaagtgactaatcctgc

SEQ ID NO: 387837 - DNA, 439 bp, Homo sapiens
tgtgccagacaccaaggcatttcttctcagcgccaaacccaccctgccgtgcccagcttctgatcctggcactgggccttgaagaccacatggctcctgcccaggggctcaatgttcagcaatgggcacaggcactgcctcccagatggagtggggtggactggcatgtgagggtcccacatcgtttttcctggggactggggacagccaccaatcctcacctggagctgcttcactctctcacagctgcgatggactcacagtcctgtcagataaggcccctactctgggtatctaagcctcccacgcccacttttctagactcagcccctttccacactgatgaccttagcctttcttttctctttcagcagctaaccttcttttcctttgttaacgattctgtatactgaatttttcctgttcaaattactgctgc

SEQ ID NO: 387838 - DNA, 399 bp, Homo sapiens
tggaggagctgatggattagcatctccaggaaattccagtcctgtggccagtgccatgagaggctgcaatgtaggccatgtttcctgagcacctgctctgtgctggggcggggtaagagggaaggagggaggaggcataagacacacacagatggtggccacccatggaggctctgccacccccagcagccccaagccatccttcctggaatcctcaagacctggccgaaatgcagttgcctcttccagcgagccctccagaactcccactggcagtgacattttctctatcgtctgctgctctgcaagcagaaacctcctctgcaaggagtaagtctatggcacattttaactcctggttacatggcagagttttactcccatgaaatagctgtgaaa

SEQ ID NO: 387839 - DNA, 139 bp, Homo sapiens
cagcagccctaagtcaaagtcaagttctgcttaggagtatccagcattcagggacttaaaatatatcttcctctttgtcttcattagcagcagcagcccccacagcattgtggtctatgctttcctttttttttttttt

SEQ ID NO: 387840 - DNA, 497 bp, Homo sapiens
taattttattgtggctattcaaatttcgagtttttttcataaatacacaatgtcacttttaatctaaaactgcctatcaaaactgttaaatagtgagtctattcaacatccgtgatcacaggcttgtagagaatctgttgtgtgccgtgtttgtttagctttgccctgatttttgtatcaaggcagtttttcaggtgaaaaaccagaatctctaggcgttgctaaaagccacacagaaaggtactgtcataactctgccccctgtgattcaggcgctcagccctcacagaacagcctctggcccttcaaaacggagattttcagaaagcacaagtgaaaagcatctttgtttcagctgtatctgccttttatcgagcagtggaggggctgcaaacccacgtccatcacaccccgaccacatacctggcgcatgcaggtgatcagtgggcttgggacataaacactccaggaaaaaaggctaaaagactatttttttt

SEQ ID NO: 387841 - DNA, 862 bp, Homo sapiens
tatttttagtagagacggggtttcaccgtgtttgccaggatggtctcgatctggaccttgtgatccgcccacctcggcctcccaaagtgctgggattacaggcgtgagccaccgcgcctggccgacaacatgatttttaatagtgaaactattaaaacaagatagaaaattattaactactaaatttcaacagtctataaagtaccacagagatgaggaaaacgattggctttaatcactgaacaaatatattctttgattagatgaagcttgttcttatgttcctctgcatcttctctctttctcccttctctctcttgggttttttttctcttttgaaccgcagttcacttactatgttttccaagtgctttaccatctgggtttgtcaatacctccctcaaaggatggtgtccagacttgaaaactgaaaaagataggagctgaccctaaagaatttaaggattgttccctccattattcttgaaaaccgctgttaaaacagaatccataaccttggttcaatttctagaagtatatttgcagctctggcaagatactcttgttgccagtatcaatgcccatccaaatttttgtatctgtctagatgcagtcccatgctgccctttgtgtgttattcctgaggactacagaattcctacagcattttgtaccatgcatggctcttactttttttaaaaaaaattaaaaatcctattgagtgcttactgaacactgttctaagaactggattatggtggtaaacaaaagggacaaaatacattgcccttgtggagcttacattatagctgggagagaaaggcagtcaatcaatggcaggtggtgttaagtgctatgaaga

SEQ ID NO: 387842 - DNA, 379 bp, Homo sapiens
atatgttcatttctcagccttggtagggtgcatgataaggtcttcggagcgatgataatggattatggaaacactgccttctaaattttaggattaaatcttttaaaaattggaaacctttgtgctggtttctcagtgtcaatgagaagttcaggagtatagtgggcatggtgactcacttatgaagaaggcttctatttgctaacagtgagatgttttatagacaatgtttagcaataatgtgttttttcatataaatatactcatttgtatattgattgcatttctgctataagcttaataagctttttaatattatgttttatatcttttaatagatggtttgtgaagaaggtgacaagctaacctactcaaaata

SEQ ID NO: 387843 - DNA, 1081 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagca

SEQ ID NO: 387844 - DNA, 760 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagca

SEQ ID NO: 387845 - DNA, 1006 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtcctgtttccttcccttcctcaccagaggctgccacaacaggccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagca

SEQ ID NO: 387846 - DNA, 555 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacactgtgtgaggctgtgtctctgccatccaaaagggggccccttgagaatggtgatccacccagttacaggggcatttagggagcagatgactgagaacattaaaaaagaacttaaatgacacagca

SEQ ID NO: 387847 - DNA, 243 bp, Homo sapiens
  misc_feature (1)..(1): n is a, c, g, or t
ngcggcgttgtgtgtgtgtgtgtgtgtggtatataaacaaaatggatactctgtattttgcattttgtcttgcctttttcactcaggatgttatcaacctcatctttaacttcttcctctctccttatttttgctgaggtgactgttttcaagtcatttgaatattacgttgtgttctaacatataattattttttatccttactccgagagttttattcctgggacctaataaatctgtgtg

SEQ ID NO: 387848 - DNA, 360 bp, Homo sapiens
gagcctacggcagaaaaagaaacatcttcctataaaaactagacagaataattctcagaatctgctttgtgatgtgtgcgttcaactcatagagtaaaacttttcttttgatagagcagttttgaaacactctttttgtaatatttgcatgtgtatatttagaagcgccttgaagcctatgctagaaatggaaatatctccccataaaaccaagagagtagcaatctcagaaactaatgtgtgatggctgcattccacacacacggtggaccatttctcttgatagagcagttttgaaacactctttctgtagaatctgcaagtggataattggacctcctagaggtcttcattggaaac

SEQ ID NO: 387849 - DNA, 394 bp, Homo sapiens
gtctgaaatgtaattttaaatatgagataataatatcaccttctgcttagcctatgactacagtctagcaccaaaggaggtcagaatttccccctttatatttagtccatctttctgttgaaagcatttgtagattgagtgttttttgtattatgaatcgggtttagtctctcccaaggcaggaagttttcaagtattacattttttaatacacagcaggtggattttgtctgaaagatagttttatgccaggatattgtacttgtttcactattgaactacagaaccttagaattattttaaagattggaaaggtataacctgtctcccatgaaagacctttgtagtggtaaatttgccaaccttgttaattttactcaaactttgtttttga

SEQ ID NO: 387850 - DNA, 284 bp, Homo sapiens
tttgaacctttgccagctggaagaaaggacaaaacagctgttctaaactgccaagaaattggctggtgcatagaagagggaatttgtctttgttgtatattttgcctttgtcctgggagtgattattttgatcagcacttttggttgtacagatgtgagccaaatatctagcagagggtagctcctgattttagttaagtaattcactgctgagacttcagattatgatgtaaagtgttctgcttaatagtgataaaagctgacctgaaaagggtgttatattc

SEQ ID NO: 387851 - DNA, 676 bp, Homo sapiens
agaccccttctccaaagctttttgcatcttaagaaagataattcctaggaaaggtgcctcacctgggtcatagccagtggaaaaaggaaagcttatgatatctcttggtctggtattaagaggccaggctggaaaaggaaggcaccatttccatcatattcttctggagagaacttagtctcatcttcttcacagaagatggggaaaggtggcccagctggtcagccctgtgcctggctgcatttctgttactatggaaggagggaaaaaggaaagccagcagtgcatgtcacgcttacataagctccctccatcaggaaacttaagaccaactccatttgatctgatcagaggacgtctataaggaccaacacagtgtcacattcaaaagcatctttctccccctccaatcaaccagtgtcctggggccttcttacctctgggtaagttctttgctatcttgggctctcctagaggtggacaatgatcttccttttggttgagagtcctaattgaggagccttaagatctgaccatttgtctaaaagtcctctagataacttctcccaagtttacattggtccttatgcaaatacacctccaaatggcccatcccagaatgtcagaatttcttaactgtaccctggaaacagagtctcagggcaaaccaagaatg

SEQ ID NO: 387852 - DNA, 394 bp, Homo sapiens
ctcaaacagctttcccctgcagctgcgtgtaaattggttttataatgtttgtctttgggacaaaagctgtatcgccagtgcctacctccttctggtgcccctaacccttcctgccacctgtcctcgtccacacaggcctctggctggcttggctggggccagagccctggaagctgggagccagggtctctggaggccctgtcacccaggggcgtgtctgagcaggcagagatttggaggattgttgaaccatctcaaaccatgaggacgctggctccagggaggggaaggaagaggagaggtaccgtttgtgtgagatggggggacgggacataaagaacgcctgtggccagcggcagacccgtcctgtgacttcaggagcaatgtaccggca

SEQ ID NO: 387853 - DNA, 240 bp, Homo sapiens
cttacctcatcaggttgttataaggattaagtgagattatataagtgaagcatatagtacaatatctactattaaatgcacgctgaaataaaatagtagctgtgaaaatgtaggtgaagaaagtatactagaaaataaacaagagaggacttcaaataatggagattaaacatagggagaggcaatatgcaaatgaggtcacttgtgccccatattgcgtcatttaaatggtagataaac

SEQ ID NO: 387854 - DNA, 408 bp, Homo sapiens
ggcttcagtatttcatttgaggtgactttccaaaacagcagacaaatttatattcaagtgtagatataaaaccatattttaagcaaattatttttgtattaccagccatttagatttaacatgtctttgttcctcgattgatatttagttgactacatttggttcccacatgaagggcctagaatgagcagtaggaagtattcaatgaggtcatagtcgcccctgatatttgtcttctatccctctctagatttcaagaaaattatacctatgggttttgaagtttgggtctttttagcaaatgaggcattatttgtagggttaatcacttgcaggactctgagcgtgggacattttttaagtattctaaatttaacacaagattaacagactattgaaaacaacatt

SEQ ID NO: 387855 - DNA, 819 bp, Homo sapiens
tcctttgctgatagggcctgcgtgctgatagttgattcagtgaatatatgtagcagtgatagctcatgggctccagaggtcagatatcttattctctaggctgaaacccttgttgctttaaggaaacaggattttaataggaatcacatgcagattgactacagggagccaagcggtagtggaagaagcaaagttggcggttttggagacggacgtctatctatccacagtgggacaaaaatgaaggttattgaaaagaatcatgcttggtggaagaagtaattacatttttttttcaaatctcagaggaataatgcttttatatttcctgcgatgacccaatttgcactacgatatgctcccttaaatgtgatttaaacagaagagaggaccaccccgccaaccaaatgtccaggtcctattccatggaacctatgaacaggttgtcccacattgcaaaagggacttcacagatgtcggtaagttaaggccattgagacgaatgattctggattgtctgtgggcccaatgtgatcaaaagtttccctagaagagctagagaagatgcgataatggaagcggaatcaaagacagatttgaagatgctgctgtctttggagagaatggccaggaggcaaggaacacaagcagccctagaagttggaaaaggtttcacaaaggactgggttgaaaactaagatcttaaatcaattcatcgtgttgggaatggagcaggatagagatcgttcctgaaagataaaacatacgtgcagcatatgcacttgtgcatacatagtgctggttaatgacatatgtcag

SEQ ID NO: 387856 - DNA, 454 bp, Homo sapiens
tgaactcaccaccattattccaacctaaatgagatactttacgttcttctaattcttgtcatttttccatccttgcactaaatgcactttttgctgatattaatgttaatgtctggcagctccatttgactaagttcacaggaaaagggatggcgctgactgtttcaactcagggtctagcacagcgcctggcatggagggcccagactatgcctgccctgtagacagcaagcgctggctttactgcatatcttctagagaagatgcactgatccaccacacaatcacatgctccacaaatatgccacagctaaactgacaatttgtttaaaatgatcatttccaatgctggcaggctgtggacagacgggctgcttatggcctgtcagcaggttgtaaaatggcaccctctttctgtggagaacttggccatatgtaccaccatgcatacccg

SEQ ID NO: 387857 - DNA, 339 bp, Homo sapiens
aagaaagttcagtatgtaatgttagaggatagtttttggtattagttcatgcttatagcttggaacacagttttaggagtttaagagataataagctgcgtgctgtggctcatgcctgtaataccagtggtttgggagaccaaggctggtggatcacctgaagtcgggagtttgagaccatcctggccaacatggtgaaaccccgtctctattaaaaatacaaaaagtaatcccagctactctggaagctggggcaggagaatcacttgaacccaggaggtagaggttgcagtgagctgagatcacaccactgcactttagcctgggtgacagagcgag

SEQ ID NO: 387858 - DNA, 475 bp, Homo sapiens
ttcaccatgctggccaggctggtctcaaactcctgacctcagatgatccgcctgcctcagcctcccaagtgctgggattacaggcatgagccactgcaccccagtagggcaatttctcggcgtaggtttctttacctgggtgtgagctccatggatgggcttcatccagccagtgggccctgtcagctctgcaaagtccagtgtgtttgcatagatgcttgaggtcgtgatgatgctctggggactgcagtggggagaaggtccacagctctcatcagatccttcaaggacctggtgatggttcagtttacgtgtctgcctggctgggctaggaggtgcccagatagctgagaagacatgatttctgggtgtgttcgtgagggtgactgaatgaagaagatatgccttcactattttgggcaggcatcatccaatgcattgagggtttgaatagaacaaaaagatggagaaaaga

SEQ ID NO: 387859 - DNA, 143 bp, Homo sapiens
tacacagactactaagatatggccctgttcacaagaaaggtctcaaacattatgtcaagagatgcttatagaacattgaagagagctcaaccatggatgtagcaacagtagatgtctgctatagaaatacagtagaaggaatc

SEQ ID NO: 387860 - DNA, 497 bp, Homo sapiens
ccctgtccagatcaaatcaactcatgtcaatttaacaaagctttgagtgcctgccactgggtgtcactgtgctggtgagtgaggaacgtgcctgccatcactctgctcttgtacacaggagcgaattaggaactgatcccattcaataccaaatttgatgctccttctgatacacaatgtattcttggtgctctggtattctaggacagtggcttccagaattttttcccaaaaagccacagtaaaaaaatgcaccttatatcaggatcctgtacacatatgtgcacatacacaagtatatatgtgtatctgtgtgtatatgtaatatatatactaaagtaaaaatttcaaaaaagtaatactatgtgtgctatgcttaaatatttttatccattttctattacatattttaataatattattgctgtattcctcatatttgctatgtcaacttaagcccttggcacagtgagactcaataacatgaaaaaaaaaaa

SEQ ID NO: 387861 - DNA, 547 bp, Homo sapiens
ttgatgaattgaaaattatcaaagtaaaatgatagggtattttgtttcatgacatcagctgctgctttttgatgtggtgctgctccccgccagtgccgtgaattctccgcctttgccgggtggtgcacgcgacttagactctgctggtgcatgccgaggagtcaggagcccagctgggtaacttttcctaatggtcaaaaggttgttccctcctccaccttcctgaagcaaccatgatttgactaaagctctttattactccacctgaatatcagacagtcatgctgcttgcaatttatttattgttttccagaggtaaactactgagattttccccacctgtttttaatgtgcttctcgttcataagtattctgatctgttagtaatatctgaaaatatcacttttaacactcttgggtgcactattgctgaagccccctcacagaatggaaagttaatttgaagaactatggacctgcatcaggtttagctacacacaccacacacatacgcacatacacacacgcacatactctacagagacca

SEQ ID NO: 387862 - DNA, 384 bp, Homo sapiens
aagtcaacatctattatgttttttgtttgtgtgtgtgtttgtttttacagaagaggctcagtgatgttatgtgtcttgctcagggtcagaaagtatgtggtaggactaggattcaagcactgttcacctaactttatgttcattaagtttttcactgtactacactgccctaaatccattaaagggttttttgttgttgttgagtttgccttccaactatgaagacttaagaaatttatggatgtttgctttaactgaaaacagatactttcattaaatgattaatcttatgaatcaaatgtaaacaaaacagtttatgtatgtttctattttccttaatttgttcaaagttttgttgctagtcttaatatattttgccataac

SEQ ID NO: 387863 - DNA, 535 bp, Homo sapiens
taaaggcatattgaatattcttgttttcatgtacctctgttcattatatgaagttcaattcaggatttgaagtctttccttcacacaatcccacaaaaatgcatatggtgagtataaattgaaaaaaatagggtatttctctaaatgcaaaaagaaaaacatctgtctttaaatttttttaaaccctgcctaaattgacatgtgctttacattagtcctgtattattcaaactttcatacttatgtgtgcattatgtatgctcacacacactttagtgatggggtttgtgtatgtataaggtacctgcaaatccaaactacttcatttgaaatttgggaaatttttcctaaaataacttccacaaatatatgtgtgtatgtaggtatatatgtatattttatatgtaaatatttatatatgcatattatatataatatatgtattctacaaatgtattatatatctataaaatagtaccatggaatgctttaaatatattgtaattggttttcagagttggggtgtgtgagttgt

SEQ ID NO: 387864 - DNA, 545 bp, Homo sapiens
taatatgttaagtatgctttgaaaatgaaagaggaaagacaccccaagaagtcatgagcaggaaataaccaggaatttttacagacaagtaaacatagctaataaacataggaaaagatgatagtaattagggaaacccaaattaagacaatgagagctaattctttatccaagtagattggctaaaatcaaatctggcaataccaagggttcaagaggatgtggctcagtggtaactcttacgtattgactgtatggatgcaaactggtaaaactgctccaggaaataatttggttttcttgaaaagttgaacatggataccttttcagtatctagaaattcactcaggaaatgcttacacataagccccttgagacagaaataatcagaatagcattgttgtgtcagaacatcaacaagaactggaaatgtaatatcccagcctcttaggaggctgaggtgggaggatagcttgagcctgggaggctgaagctgccatgagccatgctgcactccagcctgggtaacagagcagcaagaccct

SEQ ID NO: 387865 - DNA, 512 bp, Homo sapiens
ctccccctctctcgtaattgttttttcttgttttgtcttggttgggtgaaaactttgcatcaaggattgaagtttgaactggcattcagaaaccttgcattgagtgttttgtttttaaaaagtaacatctcagcctggtgcagtggctcatgtctgtaatctcagcattttgggaggctgaggcagaaggattgcttgaggcctagagttctagaccagcctgggcaacagagcaagacccaatatctacaaaaaaaaaagtacaaaattcactgggcatggtggcacatgcccgtagctctagctactcaggaggctgaggtgggaggattgcttgtaaaagcccatgacttccaggctgcagtgaactatgatctcgccactgcacgccagcccaggaaacagagcaagaccccgtctcttaaaaaacgaagcatctctaaaaggtaaactcttcatattttcaaaagaatattaaacaccttggggtagggacctcatcttacgtgctg

SEQ ID NO: 387866 - DNA, 357 bp, Homo sapiens
ttgtgtggatgaagagggccatgtctgtgaagtgctcaggatggagctggtggtggggcggccatgccggccacatggctcacacccctcacccgtcaactcggtgcccggcattttccttagctcctctgtggattaattctcattctgaagacgggaggctgaggtttcatctcagctctgttcctggctcattgctgcgcttctctgtacccgtcccctcccctgactaggggaatgagaaccttgcctatggaaacacttaggggatggtggcccgtgactccatgccagcccctcccaagcccagccaccagctgaggtcctgaccaccttgtggaccacccggtcctccag

SEQ ID NO: 387867 - DNA, 486 bp, Homo sapiens
gttttactttttgagatggagtctcgctctgtcgcccagcctggagtgtagtggcttaatctcggctcactgcaacctctgcctcctggattcaagcgattctcctgcctcagcctcccaagtagccgggactacaggcatgtgccaccacgcctggcagatttttgtattgttagtagagacagggtttcaccgtgttggccaggctggtcttgaactcctgaactcaggtgatccacccgcctccgcctcccacagtgctgggattacaggcgtgagccaccacacaccctgccttgcctttcaaggttaactgatgagtcctttcaactgttttattcttcccgttttctttgaatgttacatgtagtgattaaataactatggccattccatgaacgggtacgtgcagctggttcttggggctctccaggccagtgggctgtagctgggtggtggggtggggggctgttttctgtcactcgc

SEQ ID NO: 387868 - DNA, 733 bp, Homo sapiens
cacagcttcctgagtaaagcacatgggctttgtcatcatccccttgtgcgttgcttaaagagcttagctctgtggccacacctgtgtccccagtagctgaggccatatacataatactgagggcgagacattttaccgctgaaggggaactgtcgtgtgttttgagatctttgatttaaatggattgaaaccacaaggggccccttcctcttgtgccaccacccactgcctggtgcgttggcaggcctcgcggatgaattcgtgaggagcatgccctgctcaggaacagcagagccacccagagatttcatggcagtgcagagcagcatacctgccggccgttgcagggacttatttggggaccccagcagggcatgtggagggggtctttcaaggtcttcccatcactgagagatgccagtcccacagcccctgtttctagtccagctgagttgctctccaggccctgcccctgccctgggctcattcagctatggtcagcccaggtctaggctcttgccctacctctctgtttatctgcagtggccagcacagctcctggcccagagagcgtgctcagtaaatgttggtgaattgaacaaagtccagctcaccaacgccgtggcgtcttctcccctggccacgttcctacttgaactcagttgtactttctctgcatcctccttccctcctggcctccccacctcactcctaaccaggccccacttcctcc

SEQ ID NO: 387869 - DNA, 345 bp, Homo sapiens
ttccccttccatcatgattaaaagctttctgaggtcctcaccagaaccagaggctgaagccatgcttctagtaaagcctgcaaaactatgaaccaagtaaacctcttttctttataaattacccaccctcaggtatccctttataataacacaaacagactaagggagtgctcttataaaaagggctgcaggaacttgtttaccccttctgccatgtgaggagacagagaaagcatcgtctattcagcagagacactgaatctgctggtgccttgattctggacatcttccaaaactgtgagaaataaattcctgttgtttataaactacctagtctaaaggtat

SEQ ID NO: 387870 - DNA, 1462 bp, Homo sapiens
gataaggagctgtgaagaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaacctggcacttaagcaccatgtgcccagcacaatttatggctcatgctattatctgactggtgtgctagcgctcatttcacccaacctggattctagtcctgtgtgctgctacctgtgtgctgctaggatagtcattaccaggcccagctgtaaaataaaggctcagactaaacgaactcaaagtctttgaagctgtcaaactatattcgtgtatatgcaaaatatcttgagtttccaagacctagagagcttgggagaggacgagggtagtcttaatggctccagcagcaccagtacacccatgcatttcatgagtcagccaagaatacacttgagaaggcgagaggctgtctgtagagaaccagggaagctgtgtgcccttctcaatgtcttctaccctcgttttcccaatagtgagcagcactgtggtgaggtcccttccactgtgtactctgcatacagggtattccctgttccactcctacacagtatgcaccactctctaattttgaaattacctctataatgcctaattccatgaagggagggacagtgcctgttttgttcattgctagatcaccaagggctaacacataacagctgtcaccaagtatttgttgaataaattagtatcttcttca

SEQ ID NO: 387871 - DNA, 155 bp, Homo sapiens
ggcactgatgggaatgcagacaaatctcacccatgttttgtctgtgactgttgggtggggtctcttgccttctctgccaaacaaggcatattccaatttggcatttgtgattaaaaagaaaggacacaagaaagtaaggaaggaaatagaagaaa

SEQ ID NO: 387872 - DNA, 359 bp, Homo sapiens
tctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggct

SEQ ID NO: 387873 - DNA, 2497 bp, Homo sapiens
  misc_feature (12)..(13): n is a, c, g, or t
  misc_feature (21)..(21): n is a, c, g, or t
  misc_feature (29)..(29): n is a, c, g, or t
  misc_feature (32)..(32): n is a, c, g, or t
  misc_feature (36)..(36): n is a, c, g, or t
  misc_feature (47)..(47): n is a, c, g, or t
ggccggagccgnncagctcancgagagcntanttcnggccaggtcgncccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 387874 - DNA, 2520 bp, Homo sapiens
  misc_feature (12)..(13): n is a, c, g, or t
  misc_feature (21)..(21): n is a, c, g, or t
  misc_feature (29)..(29): n is a, c, g, or t
  misc_feature (32)..(32): n is a, c, g, or t
  misc_feature (36)..(36): n is a, c, g, or t
  misc_feature (47)..(47): n is a, c, g, or t
ggccggagccgnncagctcancgagagcntanttcnggccaggtcgncccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccacaaaaaaacaacaaaacaaaaaaag

SEQ ID NO: 387875 - DNA, 2450 bp, Homo sapiens
  misc_feature (12)..(13): n is a, c, g, or t
  misc_feature (21)..(21): n is a, c, g, or t
  misc_feature (29)..(29): n is a, c, g, or t
  misc_feature (32)..(32): n is a, c, g, or t
  misc_feature (36)..(36): n is a, c, g, or t
  misc_feature (47)..(47): n is a, c, g, or t
ggccggagccgnncagctcancgagagcntanttcnggccaggtcgncccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaaccatccatataaaccaagaaagcagactggcaactaggtaggaaaatagctatagacagtaatccaacaaaaagcaagaacaggacaagggagtaatacagtaaagaaaaaaaaatgataagcctattacca

SEQ ID NO: 387876 - DNA, 167 bp, Homo sapiens
cgaggacgccgagctatgagaggagggagggcgcgcgaggccgagtggggagcttggagcagcgggaaggtcaggggcgcccatctgcggcactctcggtttggctcagtttctgcctacaagtgtctgtgcgtgtgaggagaaaataaagtcatgagctcatcacc

SEQ ID NO: 387877 - DNA, 684 bp, Homo sapiens
aaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgccgatccatgatacatgtaatcccagtactttgggaggccgaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaa

SEQ ID NO: 387878 - DNA, 91 bp, Homo sapiens
gcactgctgaatgttatgctggtccccaagaaaagatcctgacacagcacaggttatgcctcttcttctgagctcatactgccccagacag

SEQ ID NO: 387879 - DNA, 414 bp, Homo sapiens
aggattgtgagtggggaggtggggtgggtatgggggaggaagacaagaccgcctggccggatgcaagcaggttcctgagtgaaaggtactcagacgggaaatgcaagctttcctggggtcagagaggacttatcgtacagtaaagggattggagctcagcaaaggtctaggtgaagcttgctgtccagaaacatatccttttgaaaagtgaccattcagggaggtcttaggactttgttggtaatttcttcatcctttatagagctctgagtagttgggatggcagaaagaaaacagagacacttattgaccaaaattcttgttatatgcaccaatatccaaacccttaagatgtggaaatcctttctccatgttcctatagtcctttgcacaaattcctatcatagcactgac

SEQ ID NO: 387880 - DNA, 603 bp, Homo sapiens
acatttttctctcatatggatatctattccacacaatccctttttttgaaagaccattatttcctcattacattacggtattgcatttgtcataaattaggagagggtctgtttctggaccctctattgatttctactggttagtttgcctgttctttcattagtattacactgtcttaatttttgtaactttagcatgagttgatatctggtaacataagtcctccagctttgttattcaagattacctggattttccacctgaatttgaaaaccagtttgtcaattttgacaaaaaatcctgcttgaattttgctggaatactgttgaatttatgaatcaacttgggaaagaaggaacatctttacaaagtcaggtcttctaatccatgaacatggtatattcctccatttatttgtgttttgtctacttcaataatttttaaaaaattagtccagaggtcttgcacagcttttgtaaggtttattcctaggtttttgatttctaaatgttattaaaataagattttttttttgttttctattcatttcttgctagcaaatagaaatacaattaaattttgtgtcctggtcttttacatcc

SEQ ID NO: 387881 - DNA, 322 bp, Homo sapiens
tctatgtgaccccttatcctctagccagcctgcttaggcttgttcgtatggtgctcagcgttccctggcacatcagggttgcagtaagcaattacccttcgtacctctgagtgtgtcacatttgtgacagttccattagccaacccaaattcaactccaaaagggttaaaagaaaattagattctgcctcttgttgggagaccctgtaacatcactttgcaaagtcctaggtgcaaagagagggattttttattatttttaggaatgattccaggaactagatcagtttttttacttctgtatcccacgcatctgaaatatt

SEQ ID NO: 387882 - DNA, 622 bp, Homo sapiens
ggagatcaaatttcaacatgaggtttggaggggacaaacatccagacgatatcaggcttatacatggtacatatttattacatgttggatagatgtttctacaaaagaagatggcacaagatttatgatttattggatacttaggataagagagaagaaaacattagagttttacactaattaaaagtagagggattttctgtataagtgtaaggatatgatctttgttctacttagcttaaggaggtttgtctccattaattttgagttatgctataatgaatgctgtttttagatagctttgaagaggtagacatataattaaagtatgaataatttgtttgatgttgaacatcaatttcatctttgccaaaggtcatggactttaagaccagaatttctgaggtccacataataatttaatgactcaatgataatttttggtgttaaataaaagtcctgcagatgacctttctggacacaaagttgaatttagaattatcaaagagcaagcttgaatttgaatttgatgctattattttgttataaagaaagaatctattatgcagtgctaaaacaccagaaggaagatagtatgtctgaatatcttttaattggtagt

SEQ ID NO: 387883 - DNA, 206 bp, Homo sapiens
cctctgaccttcttttgtctcttcagtcatctaaagagatttttaaaaggaaaacggtctagtgtgtgcggtgcacccctagcccagggcctaagaggagcgtcttgtgaaggagctgtacctgccggctcaggtcccttctcggagtgactcctggcagagcagagcaggcctcagccctccttacaggcgcgtccagccagccc

SEQ ID NO: 387884 - DNA, 626 bp, Homo sapiens
gcattgtctaatctgcagttatcttattaggcacatttggagcagtgctcattgtaggactaattattctccactactcaggcaaggttttcctgattttgtactcagcactatgtgagtgaaaaaagttttttaaggttagatggtggaaacatgcataggctcagagtgacatctggccagatctgtatactgttcagatgttttttccctggtttttgatagttacgtcacatgcatgtgcttatcagtaccctgctgaattcttgaagtggatcttctgcagatctctgggcttccctctgtctctcttccctccattactctgttctgccttgatctccattagctctcactttcatgtcaactcagaaagttgtcctccaggctttgtctgggttcttcctaccagagcagaggcctagaatctgtatcaggcagtaagctgggataatagtacagcacatcttttctttcctgattttcagggatctctgtccttcattgcctggcatccagtgtgtcttggttgtataaagcagaagggtaattttgattactgttaactatttttttttccactttgttaaagattgattttgtggctctttcttgagatggatgaa

SEQ ID NO: 387885 - DNA, 461 bp, Homo sapiens
agcagaaattaaaaatgtaaaaacatttaagagtcacagaatttacatcttggtgaaaaccactttttaaaaacaaaacagtggctgacttacaggaggttggcacagcttgccctgttttcagaaccccgttacaccttgggttcactgctgaacactggctgactctcctcggtttctctaacgccgcactgactgtgctcatctagtttttcttctggaattggtgttagctcttatgtttctgtgggaaaaatacacatgccttgggagctttacgggctttttaagtgtaattttacacatttgcctctctgaatatatcctaaaaacaatatgcttgctttctttacttatttatttatttattcatttatttatttagagacggagtttttgctcttgtttcccaagatcgtgtcactgctctccagcctgggcaatagagcaagactccgtct

SEQ ID NO: 387886 - DNA, 776 bp, Homo sapiens
gataactaaattttaaccaaaatattgaaagtgttaatgctgttgttatcagatagaataaactgttacaaacgcagcctccactcagaatggatcggacttgtcacttgggcctgaacagacctaattgatcatttttcatgactgctgccagcccacagtagaataccgcagttgttaatatttctaattgggtaggatgctacatggaatgtattttgttttatatattaaattactaaaattctatataaaatacagaaagttaagattagaaagccttcttacagcacaatgaatatttatttaatggctatactgttcctgtggttgaagtcccatgtatttagtatgtctaagttatgggcgactctggatctccaaaggcaaattagtcatggaagaatctttagttttggaaaatcactatgttgcttctcaaaaagtatactagttacgacaaggtagtatttagtgtcttttacatcaacattgaggctggcacggtggctcacgcctataatcccggctcttaaggaggctgatgcaggtggatcacctgaggtcaggagtttaaggccagcctggccaacatggtaaaaccccatctctactaaaaatacaaaaatcagccaggcgtgttggtgtgcgcctataatcccagctactcgggaggctgaggcaggagaattgcttgaacccgggaggtggagattgcagtgagccaagatcgtgtcactgctctccagcctgggcaatagagcaagactccgtct

SEQ ID NO: 387887 - DNA, 458 bp, Homo sapiens
ttcagtaggtctggattgggacctgagaatttttatttcttagaagttttcaagtgatgctgatgctggtgctctggggatcacactttgaggaccaccaatgaacattatctcccaccaagcaaacccttaacatgttatactcctttaggttattagaatttatacatgcattatttcatttgacctgtaaactctaagtaactttgcatggaaaatgttatcctgattttatagacgagatagtgagtttagaaaggcagtatggtggaatggagcatagatttggagttggctagacctaaagtccagattaaatctctgctcaaggctgggcgtggtggctcatgcctgtaatcccagtgctttgggaggccagcgttggcagattgcttgagtctggaagttcgagaccagtctgggcaacataggcagaccctgtctctacaaaaaaaaat

SEQ ID NO: 387888 - DNA, 294 bp, Homo sapiens
actgtactccagcctgggagacagaataagaccctgtctcaaaaaaaaaaaagaaaaaagaaagaaagaaggaaagaaactaaatgagtggtgattgcctagggctcaaggtattgaggggaaaaaggcagtgctactaccgaaggatacatggtttctttaggttacatggtttctttatgggatgataaaaaccttctggaattcagtagtagtagtggttgcactactttgtgaatatgctaaaaaaccatcgagttggccgggcgcggtggctcacgcctgtaatcccag

SEQ ID NO: 387889 - DNA, 591 bp, Homo sapiens
aaaatgggacaaagaagaattccagaaatttctctgaaaacttcagctcttcacaacaagttaggcactttcttttaggataagaatggacttaacaaatatttttagctgataatttgcgaattatctacttttcctgttatggtggagggagtaggggtaaaaagtaaggctgtcattttgttgttaatttatttctaactaaagaaaatagagctaaaacatactttggatagtttattttattattttctgttcacagtttaaattggtatttggtaagggggcagggtgaatctacaggctaaagcaactttttaaaattaaacataatttttatttctaatcacctatgctatacattccacatgatcaagaaaaattgttggtgcattaacattttataggtaaagtttatgtgaaaatgatggtatggcaatgtcctagttattaaccctttacttctaaaagtatttacattaatacataagtttagggtaaaataaatattgaagatgaaataattagtaatctgtaaccagttgcatttaagcatggctgaaggtaacaaggcagacattgttgatggtg

SEQ ID NO: 387890 - DNA, 504 bp, Homo sapiens
cacacactcatgttcacataccaagaaaggtaagttttcagtgacttttttcttcagctagtgggtcttcctcttcctacctgttatatcagcgtgtatgtattatttaagttctatttttgacaaatagatgtcagagctagagtattctagcgctagaatctaatacttcatatctagtatttgtagacagcaaagttggcttcaatatcttgcctaaaaatagaatgcatgggaattattacaatgtaatatatctcctatactgcattgttaattaattcaggatcctaaattacaacataacctgaatgacattaatcaaagttgcatgtcagtgtagtattctcatggagaataagaacaaagcaaccttgaaaactttttttgtttgtttttgttttttgttttgttttgttttttgagacagttttgctcttgttgtccaggctggaatgcagtggcacaatctcagctcactacaacctccacctccctggttca

SEQ ID NO: 387891 - DNA, 510 bp, Homo sapiens
  misc_feature (381)..(381): n is a, c, g, or t
gagtgacacagggatgaagacctcactgagaagatgagactgaagctaagaacaaaatgatgagagagagggggtgacatggtgctctagggaacctctgctcagacaggtactattcttggcgtgactcaagtactttcctaaaggagaacttgacaaggacacggtcatattgttgcggggggaaggggagtgagtctcaggagattcgatttggagccaatgcctctgctggacttctcccgggacgtgggagaagtaagccagagacaggagatgagacttggcagtgtgatttagacttgcgcatgctcttaaccatgacacctgcttctggttccagaaatgtagtgtcgcacttaaatgtgctcccctaaccanaaacacctgcgcaggtgggtgggggtagaggggtgatgagttcagttaagggaaatgtggagattgaggtgccggcaggattcccagttcatcttcaacacgccatgaaaatactcttggaaattccaa

SEQ ID NO: 387892 - DNA, 287 bp, Homo sapiens
  misc_feature (283)..(283): n is a, c, g, or t
ttttctgtagagatggagtcttgctatattgcccaggccagtctcgaactcttgggctcaagcaatcctcccgtctcagcctcccaaagtgctgggattataggtgcgagccaccacgcccaaccagttgcttaattcttacaacagccctcggaggtaggttccattgttagccccaatcttatttatttagatggagtctcactctgttgtccaggctggagtgcagtgagccaagatcacgccattgcactccagcctgggcaacaagagcaaaactatntctt

SEQ ID NO: 387893 - DNA, 439 bp, Homo sapiens
ttttgtcacctataaattagggataataataataaatacaacatggaacagttacagtgttaaatgattgaggcatgtaatttgccttacgaaatgcctaactcatggggtgcccttaagaaatactactctcccccacctcctttacaaaattgcatgtctaatgcagtgagaaatgccaggcgtggaagatattctaggtttgatcatctgtggtttcttggccaaaacaagaagtttgagttctacattttattttgagttattaaacattgccatgcatccacaagagctgtattgtggcctgtagagaaacatagcatagtaatcaagagtgcaggctttgggcccacagctctgacctgaggcaaattccctacctctctggccctcagtttcctaatttgtaaagtgtgtatatgtgtggaggtggcaatga

SEQ ID NO: 387894 - DNA, 364 bp, Homo sapiens
gctgtacaggtccaataacagtacaggtcacaggaagatatatgtataggcctatgtgaatatgcctaaaacaaagagtgtaaattataagaggtatccacaaagagaacacttggtatgggcctcaactttcggaaatgccacattttatctccttatcgaaacttctctggccaggcgctgtggctcacacctgtaatcccagtactttgggaggcccgagtgggtggatcacttgaggtcagacattcgagaccagcctggacaacatggtaaaaccccatctctactaaaactacaaaaattagctgggcatggtggcacggtcctgtaatcccagcttactcaggaggctgagacagga

SEQ ID NO: 387895 - DNA, 535 bp, Homo sapiens
atggagtttcaccatgttggccaggctggtctgaactcctgacctgaagagatctgcccaccttggcctcccagagtgctgggattacaggacttagtcagtgtgcccggccaagattttcaaaggaagcagggaactaggttttaaagaccttattcttaaggaggaaaaccaggacattaggaaatcaagataagagattgtggcaagacactgaaaactgtccttggatttagcaatatggaagtcattggtgactttagcaagggttattttggtggaatgatgagggcagaagcctgagtttagcaatatggaggtcattgctgacttcaacccctcttccctttctgccatgagtggaaggaagcagccagagaccctcaccagatgcaggtgccagtgccacacttctggcacaacctgcagaactgtgagccaaataaacctcttttctttatcaattacacagcctcaggtattcctttatagcaacattaaatggactaagacaaggtagagccgagagcaatgg

SEQ ID NO: 387896 - DNA, 727 bp, Homo sapiens
ggacgctcagagcccagctcttgagagttcaagtatccgacagttccccactgctcccaggagcggttacccgggcactctgtgcccctcattcctgtttgggccaaggccgaggacctgcgagtagggctcagttgcctggagccccttcagcccatcccccagttcactttgcttgtgggatctccccgttgctcctgcccctggactgagtggcaggccatcctacaaacacccgcacactcgacatcagtggtgtcaagacaactctaagaaggttttccgtgatcctgcaagacctgtgttccatcctggtgattctgtcttcaatttcactgcacaggtaccacagtaagccagtgctgtgtgctccgagttccagggcatcccccagctcagccactacactgagcacaaggactctgtggggcccaggagcaggtagtcacccctttggggtccacaacacccggctgtccccagacttgtgtccagggaagatagtgttgagggccctcaaggagagcggggcagggatgcctgagcagcacaaggaccccagagtccaagaaaatcctgatgatcagagaacggtccccgaggtcaccggggatgcacggtctgcattttggcccctgcgggacaatggaggcccctctccctttgtgcccaggcccgggcctctgcagacagacctccacgcccagagctcagaaatcagatataa

SEQ ID NO: 387897 - DNA, 659 bp, Homo sapiens
gcatgtaaaacacttagaaagtgcctggtatacaaagagtgttgaaattactcttcttcctcctcccttccatcctcctttcttcctcccttccatccagtaaactgtcaccgccataccactgactcccattttccctgcattctggatagataattaaccaagtctgttacagtctcccttcacattctcttagattaggccacaacaccggaaaggtttatgtaaaggcccagtctttgggctccaagactagtttcctcattcgtactataaggccaaaagggaaacaatgacagcccccgcacagagcagtgtgtgtggcacctaatacatcattagcgctcaaaaaatggcaaaaaatggagctgccattaatgtaaggacatcaatttctcaaacacaacctaagccccctaactcaagagcctaccatggctactttgcagcttctcaaccaagtctgaagggtaggctgaggcgtaaggcaccctcagctgtccatgctgttcctttcctgactggtcctttagctcccctaagcctctctttccaaggctctggcttccttacccaagttcatatctgcactgacccctcccctcagatctctgctcttctgtctttaccagccacccttcctcttgtgcttcggagtg

SEQ ID NO: 387898 - DNA, 239 bp, Homo sapiens
tgtcagatttcaaatgattgaggtgacttgtaagaatttgttttatgccctgttgctgatcaaatcattggtcttccctatagctccttacaaaattatgcaatcagtgttccatttggagtaaacatttagtgtcttatcttgatagagtaattggctacatttctctttctatgcatgaagttgtgtaaaaggaccaattcacatgtataattggcagacagcatgaattctggact

SEQ ID NO: 387899 - DNA, 309 bp, Homo sapiens
gcaaatgaatgcagccaccttcaaattttgcatgatgtgggcttatatgacatgaatttccagatcctagagactggattctaagtgccaatttaggcagaaggatcgcttgagcccaggaactcgagacccgcctgggcaatgtagtgagaccccatctcttatattaaatttaaaataaaaataaaaataaactaagtgccaagttaagaaggtattactttctggcaggagtcaaatattttagttagtgaccgaccagtctccaagtctgttattgagtgccactgactgaatatgacaggcctg

SEQ ID NO: 387900 - DNA, 172 bp, Homo sapiens
tcattcttatatcataatacattgggttttaaagcttccggtatccattatatcttgatctcattaaacatacacttaacctgtgactagaaagcaggtaatagggaggagccagctccctattaaaatagttcaagatatttaccaaaagcaaatggaaagctttgtttac

SEQ ID NO: 387901 - DNA, 413 bp, Homo sapiens
tgcaggatgtcctgggagaggttggggagcggggcgtcctgcatggagtcaacccgaagagtgcccctcctgtcccaagaggtattcatggagcgcgcggccctgccaggcacggcggctttctcgggagaccaaaggcaggcaagacagatgtgccccgtctcccgggagctccccagcctagttggggagaccagcaggaggagtcgccacaggtggtcggggcaggcacaggtttgtgcaggcgcacctgcagggatggcacggaaggcttcttggaagaacagtctgagcggaatcctgtgggggcgagtaggagttagccaggcagaggaagggaaggaagagggcgaggcagaagccaggcagcaggagagcgaaataggactccgtgtggctgcagtgtccagttc

SEQ ID NO: 387902 - DNA, 522 bp, Homo sapiens
tgtaggtactctagaggatctgcccggagccttaaccctccgggtaaccccgggagccttaaccctgaggttgggctttcctgtgcttctcacaggccacagaatggtctccctttagaaagcttgcaggatgtgcaaaaccaggtgatgggccctgtcagcccacaggctatagttggctgacccttgtagctgatgaatgggatttgagggagggcttgtctgatgccctgtcagggtgcggctgtgtctcaggcctgggacatggaggaggtggggttctgctggcgggtactcactgttcgaggagccctttaggaactgagtcagctcttcagggcaggcgatgtggagccccagacggaggcacatctgtgtcaggcaggacttgggctaggtccctcactggcctccagtgcttttctttttgttgttgttgttgttttgagacagtctcgctctgtcacccaggctggaatgcagtggcacgatctcggcttactgcatcctccgcctctaggg

SEQ ID NO: 387903 - DNA, 387 bp, Homo sapiens
tcctgagtcttgctgatgaagaacgaagctagttggccaataggcgttcttttctgctcatgttttttcacacacaaaacaaaacgaaacaaaacaaaacaaaacaaaacaaaaaaccaccattttcatgcttaatatcaactatgtgcccagcactgtgttagaaccaagagactcagaatcataaaatcagaaggaacctggagatttttgagaacaagtgcaaaagccgttttcctgataatacaggacttgcagaagcattctcatgaaagcttttgctatacagccatcctcaaaaggtttgcaagcttccttaccctttgtgctggggttttacttttgaaataaaagccgatctcctgggaaaggccataaagacaaaat

SEQ ID NO: 387904 - DNA, 655 bp, Homo sapiens
tagacatggggtctcattctgttgcccaggctggcctcaaactcctgactttaagcagtcctcctgcctcggcctcccggggtgttgggattacaggcgtgagccactgcacctggccaggacttatttcttttaaaccgaatctaagtatgttctggcaagtatgcaatacctagcggaatgcactggcctgatcagcattcataccatagtaactgatgttgaaaacagcacaaataaaccagaagttgaaaatggcaataacatgctaaaaatttgcaagtcaatttgttacacttgtccaaatcttgattttttttccttctctatcgttccccccccaccaccagctttatggaggtataattagcaaataaaaagtatacatatttaaggtatacactgtgatgttttgatatacattgtgaaatggttaccataattaagctaattaatatatccatcacctcacatagccatggttaagtttctgaagtctcttttaatctacaaagtactccttccttttttccattgtcatcaccttgcagaaacagagtcagttttcccacattctgtatttatctgtttgtttctttgtggccgcatgtaacacattcctctgtctcattctaataaatggacattagctcta

SEQ ID NO: 387905 - DNA, 276 bp, Homo sapiens
gattgttcatacttgattattagtttctaaagaaagtattcttaattccaagcctaatagctcttatgtcattagtttctagtgcagagaaatgtacttgatgaatttgtgttgacttttttttttgctagccaatatgaaggttgccagtccctgccaaaatcagcactaaaactatttttcatgagtaataacaataatattcttttttaaatagcacctttaacccaaaaatcttaagcctatataaacattcactcaacaatacactcaaaa

SEQ ID NO: 387906 - DNA, 658 bp, Homo sapiens
ggaaattccagcttcctagcaaaatagatggcacttttatccctcatttctcttgctttttcaacaaatatgttaaaaaacaattacatttcagagtgcaattttcattccctttttattgtggaatcgtggcagggttttataatctgcttaaaacacctggacttaacacaacatagggcaattataagggtcttcaatatagtgtgattatggtttttaagatctgaggttatttttgaaagaaaacagaagttcctgtgtttagtaagcaaatagaaaaaccaagatagtgtcaaccgaggtcaaagggaaaagaggaaaggatcaagactcactaggatgatcttaatatctagtatattgcctgtcagtcaattggcactcagtagagatttattgcatgagttgaatgaatgaatgaatggacattatgtgctttatatttggaattgatagagtcccacttttgagcgggtaaatgagtatgttctgtcctatgggagccctcgtttcacagtttctccttcatttaaccaaatgttctgggatggaaaaacctgctgattgcgaagttgcagaataacgtccaggctgagatagtgtcctggatggtctatcagtgggcccctgcctgtggctccctctgtaagcatgc

SEQ ID NO: 387907 - DNA, 154 bp, Homo sapiens
tcctgacctcagctgattcgcccacttcggcctcccaaagtgctgagattacagatgtgagccaccatgcccagacgatagggctttttatcattctaaaaagaacccattcttggctgggcatggtggttggctcacgcctctaatcccagca

SEQ ID NO: 387908 - DNA, 587 bp, Homo sapiens
ctagccctgtgctgagtgtctccaacaggcagcccaccaggcctgcctgcacacaggtggcacggctggcagggcagctgtcacagagccacctgaggcgttgcgctaggaagagccgcagctcagcggtgggcaatgacggcagccactgcgccagcaccagtaccggctgctcgttgcggattggtggaggtgggcacatgctgtggtcaccctccacagcctgtgggtggagagaatgacagtccctggtcagctgtggcaccctgtcaacagtgggactttctggctccatttacttgcctacggcagcagtcagcaacatgatctactccatcctgcccacaggttgtgtgtgaggctcaggaaagtcagaggggcacagatgacagtcactactactaagagtccttcagcattgttaatccctcaaccttagttttcagcctgggttggcctaacccctaactgcatgttcctaagataatcctggggcttgctcacatgcagttgcttccaggacccctacagggccagaatcctcattccagtgacactaacagacatggccaggctacaggtaacag

SEQ ID NO: 387909 - DNA, 478 bp, Homo sapiens
ctctgccttccgggtccaagcaattctcctgcctcagactccccgagtctgggattacaggcgtgctccacgatgcctggctaattttttgtatcttttgtagagacgcgctttcaccactgcgccgggccaattgttattattttttttatggaagacggggcccgtgaaggccagagggccaacggcccatgaaaggcccagcgcagcccaggttagagagatgtgatttcaaaacagactcattatttataaccatcagctcctggacaagccaagtcccttctccaagcctgcttcctaatctataaagtggaggatatctggagctaccttattgaacacagaaggagtaagtggataaaggtgtgccagcgcccagcacagtgcctgccacaaagtaggcattccatcaaagaccaatcttacaaaaacgaaatctggtcctaagagcaccttagaaagagtcacactgctg

SEQ ID NO: 387910 - DNA, 441 bp, Homo sapiens
caaaactctgtctcaaaaataaataaataaataaaataaaaataaataagaattaaaaattttaaaaaaagacatgagttactggtttcaggtacacagtctttaaaatgttaggttgtttcttttgatttttattttattttattttattttattttattttattttattttattttatttattttattttatatttatttttgagatagggtctcactctgaccccaggcttgagtgcagtggcacgatctctcaccacagcctcaacctcccaggttcaagcgatccttgcacctcagcctcctgagtagctgggactacaggtgtgccccaccaccctggctaatttttgtatttttttgcagagacagggttttgccacattgcccaggctggtctcgaactcctgagctccagcaatccacctgccttggcctgc

SEQ ID NO: 387911 - DNA, 450 bp, Homo sapiens
aggaatcaggagacattcacaggactggggctaatcagaagttgacatggtggattagcatccaagatggagtcacttttgtctccacatatacagagtattttattatgtgccatgccttctgtaagtgtctgtgactcatttaatcctcaaaattgccatataaagtagattatattattctttcattcttacagatggaaaagttttccctgttttattccttgcctgatgagttctttatcttgtacccattatagaaaacttttcctagtcacccaattctagtttagagatacatgatatatttttacagcatatagcatttccttggctactacaattccattataattatctgttggtttgtatcatccactagactataaaccttgtgagggcaaacactgggccaattttaaggacactattatgttcttaacggaagac

SEQ ID NO: 387912 - DNA, 4819 bp, Homo sapiens
cggtgaggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387913 - DNA, 2366 bp, Homo sapiens
cggtgaggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcatcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387914 - DNA, 4590 bp, Homo sapiens
cccacgcgtccggacccacgcgtccgcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387915 - DNA, 5442 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctctttaaaaaaaaaaaacacaaaaaaacaacaacaaaacaaacaaacaagagagggaggagacagaaaagaagaagaacaccaccctgaagggacaccacaaaacactaaccgacagtcgcggcggcgctacatcagggaaacacacgcgccggcgccgccgcgaccggcgagggccgagactacaaccaccgagcttattatttatgagagcacacaccgcgtggtgtacaccaacacacgagacgcgagacgcgtcgtgaaaaaaaccatgtcgcgagagcccgcgacgagcgcacctcctggtagatacgacaggcgcagccgaccgttgacaagctcggactagacaagagatgcgttgcacccccaactaacgtgggggcgaccaccataatgttcgagcacacaaacaagccatctcattattaaacggggcgcctatgagaggaggatcaaccatattggtgtcatggacagacgtcctatcgacacgagctggtgatcaaaaaggcaggggtgtgattccacccaccagctgccgcatgcggcggaaatgattgtacgcagcaagccgccgttcagcagaagagtattagagg

SEQ ID NO: 387916 - DNA, 4994 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctctttctcaaaaaaaaaaaaaaaaaaacttgaggggggggccccggtacccaaattggccctataggtgaggccgtaattacaatttaactgggccggtcgttttaacaactttccgggactggggaaatacccctgggcgggttacccacaa

SEQ ID NO: 387917 - DNA, 1084 bp, Homo sapiens
  misc_feature (11)..(11): n is a, c, g, or t
ctagaggatcncctgtgtgctctggttagccgttctggagggacagaggctgccagcagggacagcagcagtagtgggaagtgctgtggggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387918 - DNA, 4581 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387919 - DNA, 1132 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagctcttcccagaagccctccctggcagctcctgtcctcctctgctggatcctgtgagcaccacagcctcctgtacaccctgagctatgcctctcaaggccctccaccagctcatcccctgctgtggcacaagccctgctttcagagtttccctgcccagggaatgaatgccccttgagagaccacacatatgctgcaagtccagccctgctcagagccgttctttgccaaataatcaccttgttattaaagagctgattgttctacta

SEQ ID NO: 387920 - DNA, 355 bp, Homo sapiens
caaatctctagcagaaatcgaaaaagaggtaagcaagccatcaggggaggggagggcaggcctgggccatcgcctgcacaccggcgtctctcgtgtgttcccctagggatccactccaagagagggacaggtggaggtgttccgttctcttctgagaaaaacactttcgttgcacccaaatgtgtttcttagataaagtaactaaattctaatgtatttcctacttccagtcaaatatgacccacatcttgtcttctctaagtcagaatgttttacatgacagacagagcctcagttctccttttttaaaagaagtctcagctttgggaaggtggaggttggaggacaggcacca

SEQ ID NO: 387921 - DNA, 566 bp, Homo sapiens
gtgtaggaatggaagcatttgcatggctcctggaataaaccaaggctggtgttcagcgcctgggttgttacggtcttgctggtgcattttgcccagtgggcagagatctggatcaaactgccaccccgtagagtcccttgggcccgctgtaaggcttgggacacactttcttcctcttggatgtcctttctagtatggaaaaaaaatgtggctgctgatgtctagaaacttccaaattccttgagaggacttgagcccagtggaggagttatgcttgattgagaaggaggcgctggccagaagcacctgctctgcccgctgatctgtgctgcatttcagctgttgatggcgtcagtgcttcctgagtcttggggaatgctccttgtaatctcctttctctcgtccttctcttcctcaggcacatctccctaacacttcctgccaccttccgaggcaggaacagcacccggacggactacgagtaccagcactccaatttgtatgccatatcagggtatgtggagccaccgctgcaggccagctacagagtctgtgtcccgggcgcc

SEQ ID NO: 387922 - DNA, 4509 bp, Homo sapiens
gtgacttcagtttttcgtctttcaacttcagttgctcatctgcagtcaccagctgggatttgaacccagccaatctgactcctgagctcctctttcctcccacttagtcttttcccctgagtccaacagcaccttagagcatgtctaatgcacgtgcttactgccttcatctcattgcagcctgtccctgccagctgtgtcaccttcatcctgctgccagcccctggtgactctcccgttacagatcagagaccagactccaggggtggagagtaggggttctggaccagccgctctctgctcctagagctcttgtctacacaactgcctggtgctcaggggatgacgaggcgcctgcctctctcagtaggttgtgtgtcctggcagcaggggtgggacctgtcctctttcatagctccagcacatctgtgctggatgtcacctggctccatccagtgacggattcatattctctgtttcgacatcttcagttgctggacaactaaatgccatcttcaatacctttaatgccatctttttttttcttcttttgcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387923 - DNA, 4846 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387924 - DNA, 4529 bp, Homo sapiens
tagaggatacacactcggcgaggtgccaagaaatcatgactcatctcaacccacaacgccttcccagtcatcagctgcctccaccccagcccccgacgtttccaggcacatctccctaacacttcctgccaccttccgaggcaggaacagcacccggacggactacgagtaccagcactccaatttgtatgccatatcagaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctcttt

SEQ ID NO: 387925 - DNA, 4819 bp, Homo sapiens
  misc_feature (4737)..(4738): n is a, c, g, or t
  misc_feature (4740)..(4740): n is a, c, g, or t
  misc_feature (4746)..(4746): n is a, c, g, or t
  misc_feature (4748)..(4748): n is a, c, g, or t
  misc_feature (4752)..(4752): n is a, c, g, or t
  misc_feature (4774)..(4774): n is a, c, g, or t
  misc_feature (4798)..(4798): n is a, c, g, or t
  misc_feature (4812)..(4812): n is a, c, g, or t
  misc_feature (4814)..(4814): n is a, c, g, or t
  misc_feature (4817)..(4817): n is a, c, g, or t
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtcccnngnatattntnaagngatttgttcttggaaggaatcntgtttattttttttttaaaaattntaaaaagtttttancnttncc

SEQ ID NO: 387926 - DNA, 4308 bp, Homo sapiens
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctgactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtggtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccatccactgtgtgattgtctgtattcttaatataatttgttaaataaacgtttgttttaacctcttt

SEQ ID NO: 387927 - DNA, 455 bp, Homo sapiens
gctatcccacagtgatattcaccctttcgtaacagatcttttccaaaccaggctttctcaatttcaccatccccacctcccagcagcacatctgaagcccatctgaaggatagttaccagaggatgggaagggtatgggggattgaggggaggtggggatggttgaactctcatgagttcaattgttttcatttctagaccccacaaataagtgagaacatggaatgtttgtctttctgttcctggcttatttcacttaacataatgatattcagtttcatccatgttgctgcaaatgactgaatctcattcgtgattaaatagtactccattgtgtatatatgttacattctctttatccattcatctgctggtggacacttaggttgcttccaaatcttagctattgtaaacagtgctgcagtaaacataagagtgtacatatctcgtcaata

SEQ ID NO: 387928 - DNA, 478 bp, Homo sapiens
  misc_feature (474)..(477): n is a, c, g, or t
atgtctcatgcaatatttgaaacatacatttttttttcattgttcatttgggattcaaatttaactggatgtcctatattttatctggcaacactaactagttaacagtcaaggatcctattactaatcgagggtgaaggggcacagggaggaagggtgaccactgaaggacaatcagaagtctctgccacaaagtgagacccctcaaagtgggtggcaataaatgttggtcctctcttccctttccctgtaaggcaaggcaaaaccagagggtggctgcagggataactgctggtagagccaacatctgtttttgaaatagaaccaatgttctattttaatggctagtttaatcacatgagatgcatgtacttggttaagacctcagagatctctgctgtatgcatgaaagagacaactgtggcctgaaaagcaacattaataaaagcactgcttctttttaatcacaaaaannnna

SEQ ID NO: 387929 - DNA, 383 bp, Homo sapiens
tttttaattcatatcgtttgaagtttcaaatgtgcatttattattctaaaatatacttaaatgttgaggactaccctgaacatttatgcttgatgctttaatattaaataaaagaacactacttatttcaaatataaaatacctattgaattggatatgatttgattactgtttgctgtctttacaacttagttttggaaataaccaaacataggcaagtctttgtttttctcttgtgactataaaatccagtcattgaaaattaggtcaatgagaccagatgtggtagctcatgcctgtgtaatcccagcggcactttgggaggctgagggggagtatatttttcgaggccaggaattcaggaccagcctgggcaacataat

SEQ ID NO: 387930 - DNA, 896 bp, Homo sapiens
acagccttcactgcagagcacgccacgcatgggcacgtcaagatgcaccatgcctacaccaacgtggtgggcctgggggactccagcacgtggaggctgccttgcctcaaccgctatgtctacatgttccttgctcctttcctcctccccatcgccactccactggtggctgtcgagcggctgaggaaggtggagctcgggacagccctgcggacgctggccctgatttctctgggcctttattctcactactggctgctcctgaacgtgtcaggcttcaagaaccccagctcagccctgggctgcatgttcctcaccagatccctgttggcccacccctacctccacgtcaacatcttccagcacatcggactgcccatgttctcccgggacaacaagccccgtcggattcacatgatgagcctgggggtgcttaacctggcccggctgcccgtgctggactgggcgttcggccactcgatcatcagctgccatgtggaacaccatctattccccaggctctctgataacatgtgcctgaaggtagtcgagggctgggctgggggcgctggaataaagggactgttagaggatggaaaggaagattcttcggcctgggggcgttgctcacactataatcctggcacttgcggaggctgaggtgggcagattgcttgagcccaggagtttgagagcagcctgggcaacatggtgaaaccccatctctacaaaaaattcaaaaattagcggggtgtggtggcacatgcttgtggtcccagctgcttggaagctgaggtgaggaccacctgagtctgcagaggttgaggctgcaatgaaccataatcgtgccactgcactccagcctggtgacagagtaagaccctgtctcaaaaaaa

SEQ ID NO: 387931 - DNA, 484 bp, Homo sapiens
tacccccttggtggctctcctcacgtctgccttaacactctcacctaagcagatgtgcgagtccagctgcctcacgcccgctgtcttttctgggcatctttacagctaccgtagcaggttttcctctttaagtgaacgtgcatcatcctagctgaggcttttaaagggaggactcgctgcctcttggaatatattaaattctgatggtgaaacagcctgctgagctaggtagggcctcagcaacttccttatgagtatagtatttctaaaaaaagctgtcgaggccaggcatggtgtctcatgcctgtaatcctagcactttggaagactgaggcaggagtattgcttgagccaggagtccgagaccagcctgggcaacctagcaagactcgcatctctacaaaaaaatttttttttaattagctggatgtggtgatacacatctgtggccccagctacagctcaggaggctgaggcaggatga

SEQ ID NO: 387932 - DNA, 495 bp, Homo sapiens
tggaatctgcttgtgggcgggagatgtggctatgtggctataaaggatgaagatgaacgccctgtttgcttttcagcctcgcttggatcaaggttaaaaggccggttgtggccttcttggtggaagaaagagagagataaggcactgtcctccccttcggagggtctggggatacactaatccatcaaaaccactgagggctgggcgttggtgtgtgcctgtggtcccagcactttgggaggctgagctgggaggattgcttgagcccaggaggtcaaggcgtaagcaagctgtgatcgcaccgctgcacaccagtgcctgggcaacaaagtgagactctgtctctttaaaagaaaaaagaaaaaaaagcctttttttaaattaaaaaaaaaatcaagtctacctgaatggcctgcagttggacccacaaaccaggtacccaagttaccaggcaaggcagctgcagttgtaccagtcagaagtccacaagatttg

SEQ ID NO: 387933 - DNA, 409 bp, Homo sapiens
gccctattacccccaacatctaagcccctgggaaatccctcctctcactcccatctgcctcaggccccacacctgtcatcatcttcaccctccttcctcccacaccaccagaggtcttgagcaaccagtctgtcctctcctttacttccttctggctcctggaaatatccatagccctctcaaattgcaaaaaagggagcctaggacttccaaataggaaaagagtatcctatttctgttccctatcccaagaggttgtcaccttcccagaggcaagagaaagtccagagggtacctagagatcaatgtttggaacagtgctgggaaactggattaacaaggttttctagcccagtcaagactgtttgaatcagtatctgtctgaatcagctggacagatagcactttt

SEQ ID NO: 387934 - DNA, 126 bp, Homo sapiens
aggccctcatcagtttcagaaagaaaaaaaaacctaccttttagtccacaattcaaaaaatgttaaacaggccaagtgagcgcgcacgcctgtaatctcagcactttgggaggctgaggcaggcac

SEQ ID NO: 387935 - DNA, 340 bp, Homo sapiens
tggatacaccaatgctcgaaagaactgggttatcagtccagttagtgtagttggtttttaaagggagtataggggatttggcaaataagagaatgagaatatagcaaacctatacacactagaatatttgtcaatgtagaatttaatgttttttttgcatacaaaggttacattttagagtaaaaatagacctgtgactgaaggaaaattaaacacttcatttcctttttctgtttgagacagagtcttgctctgtcgcccaggctggtatacagtgagccaagatcacaccactgcactccagcctgggacgacagaaccaaaccatgtcttcaaaaaa

SEQ ID NO: 387936 - DNA, 299 bp, Homo sapiens
cgcagtagtgtgcatgcataagcagcatatacaggcacatgggcacgtgggcttgtgtgtgcttgtgtgaacagtggtgtttcagtccccactaacaatgggttgagcctctttcaccacccactgctacctggagccaccttcaaaatcctgatgaatgacaaataattgcacaactgtgaatcattgttatttttaattgttggtaagaaagtcaatgtagtgatgaaatagaaacagagctccccagattgcttgccaccagctgctgggtccttccccaccccctgcagaacccc

SEQ ID NO: 387937 - DNA, 324 bp, Homo sapiens
taggtgtgaaattggtatttttgagatgcatactgaagtttgtaaggataaatgacataatatataatatttgctttaaaatcctccagaaaaagaaaaagggagtagggctggatgagccagatatagtgaaatgctgccgctgtcaccactgagtgacaggcacataggtgtcctccgttcactccttttgcatatgtttgggaatgtttgtgataagtaagttagaaaaataacccagtcctctatctactggagcacagagatgcccccactgcccaactctctgaaaaggccctggcctcctgacacactgcttggcac

SEQ ID NO: 387938 - DNA, 262 bp, Homo sapiens
cccaacctttacagagcttcatgcacaagcttatcaatgagtatggcctgcccatctaaagattttctaagaggctgcccacgtaaaggggatgtcagagctcctggagctttgggacagccacaagccctctacctggttctctatctaggtcttttcctccttcccattgccccagtctctcccagagctcagacacactctataccttcccatgggaacaaaaaagcccccaggtgagtgttttttggctgatgtgtga

SEQ ID NO: 387939 - DNA, 277 bp, Homo sapiens
cctgtactgaaaccatcccagaaaagacgctcttatcaagcttattattaagtctctccagtgtaagtcacaaatgactctattattttgactgcttccttgactagtatactcattaattttttctcaaacataaaaaattaaaacctaggccaaaatatcctttgaagtcaagaaaaaacatacatgagagggaagacactgtgatttcaaaaaccttaaatgcacttttcccccttcaaattcatacgtaatacattattagtcttaaaaatga

SEQ ID NO: 387940 - DNA, 145 bp, Homo sapiens
ctggagctgcccagtgggcaagccagggaggctctgggcaccagctgtccttgactgcctgtccctgaagaactcctggggactctactgcagaaaaggacaacagctaaatcaggcatagactgtaacaggcgaggtctcctgg

SEQ ID NO: 387941 - DNA, 369 bp, Homo sapiens
ggccctctaatctgctctccacattgtggctagaaggggctttctgagaagactctgctctgttggaaacctctactggctgaccctgcccacgggactatgttcaaacttctggccttacattcaaagccctgggtaacttgatcccatgcctgccttttcttctagacttctcccctgtccatctggaatgtgtccttccacagcaaactgcctgccacttggcccatgctctatgctttccttctgcacgtgctggtcccttgccgacaccactgcaacctccaggcaggcccttcccctaccaccaaccctcactgtgctctggcccaggcccctgcagggagattggcaggcctgggctcaggc

SEQ ID NO: 387942 - DNA, 158 bp, Homo sapiens
gatgctttgtgaagttactaaaaatagttacatttctttatgttggcagtaatgactgccacattcaagagaagagaaaggaattgttctataaagaacggctcattttaggggttaaactttaggagttaaacacaataaaacaacttcaaggatgg

SEQ ID NO: 387943 - DNA, 810 bp, Homo sapiens
ggaattttattacaaagcattaaaataaacagcactttggcagggactaggacaaatgttgggtgaaatgagacagaaggaggccgatgaccccaagtcccaaatgagtagaaaggaggcttttatcagctgggagctatgggagaaccccaggcccagtgggcattgctgcaatgacctcatggtatgtatgtgtgtatgtgtgtgaccacctagaaagtcacagctctccaggatgagctggccccatagcagagaaaagtaaaacccccatatccctggtaggacaaatctcccatgagttcagcaagaagacttgggatctgtggacaggagggcacttggtaaaatccttcatttgaggttgatgtgaaaagttgaactcaagatcctgaggccttatgtccttcccactcccccacagggctcctgctgagccagccctgactcccagatgcaagagcccagggaggagttgggagagaggaaaacctgctgggacctcagggcatggaaggagccctggacctttctcccagtgatgcctcccctactgtcaagttcctctggccctggagcttccagggacccctgcatcctttccttcctgcagccctgcctttgccaaagctccatgcatttgcctccaagtgggtccccaaccccaggctctgggagctgtgaagaggctcagggttcctgcagtctgcaggaggaaaccttgctctaaatgggcctgtgtgggttctgggatcccttcctgcacagggccacctgcaggtcccacagatgtatcttccctagaagagc

SEQ ID NO: 387944 - DNA, 411 bp, Homo sapiens
gaaaaatggattgcatttttttgtgtgtaacaactgaagccttctgtttagtgaaggaccttgtggacgttaacggacagaagttagatacagtgggagaagtgttttgcaatgtctgaaactgacaagtcattaatatatgaaatatacaggtaactcctatatttcaacaaaaacgaggaggcagcaacctcagtaaaaaaggggaaaaggcaatttatggaagagaaaaacccgaaaaggcctaatttactgaagaaaatgtttccaaactgaagataatttaagtgatgcttaaacctatcaatattttaaaaagtgcaaagtgaatgacatcactttatttatttattagacaagatcttgccctgccatccagactggagtgcaatggcgcgatctcagctcact

SEQ ID NO: 387945 - DNA, 230 bp, Homo sapiens
ctagatgtgaggacaggattggaaggattaaccctgaaggcagacagatcaattagcagattgtactatggtccagaccagaaataatggcccagaacaggccagtggcagtggaaatggaggagaagatctattgatgatgtgggggaagtggatggaggtaagagaatttttaggaaatagaacgagcagtccttaatggggggattaggacagcacagggggagcat

SEQ ID NO: 387946 - DNA, 243 bp, Homo sapiens
cagacagggcttagctgagcaagaagtgggattctaggcagaggaagcagcatgagcaaagcccagaggactgaggtagcctggtgcatctggggaaatgcaattgagtttgtccagtgtagctgcaacataggacacaagaagggcccagtgggaggaggggagtgaggagttgatctcggcgcagaccatgctcactacagttttgcttttctggccatcttgattcctttgttcatatat

SEQ ID NO: 387947 - DNA, 192 bp, Homo sapiens
agagttggaaaccagcctggacaacatagtgagaccccgtttctaccaaaaaaaaccccaaaagccaaacttctatttccaaattgatttccatagtagtgaagacaatggacaattccaacaccagggaacaggtgccccagccgctccatctactcaccaacacttgttttgttgggcttttaaatttcc

SEQ ID NO: 387948 - DNA, 142 bp, Homo sapiens
gtgaagaaatgatacagataattcttgctaaaagcttggctgttaaaaggaggagagaaacaagactagctgcaaagtgagattgggttgatggagcagttttaaatctcaaaataaagagctttgtgcttttttgattatg

SEQ ID NO: 387949 - DNA, 434 bp, Homo sapiens
aaatcgtgggagttaagaagataggaatgcttatggtcctttggggagttagggtgccaggggtgggggactcatctcaggaaattccacaaattatacattcttgttttagttctagaaaatgtgatttttttccaaggttagggcaagaatgacaatgttgtttgagggtgttaacatctaaaagtgagcaatttgtacaatttttatttgtttattgttacttaggtattcttttttatttcatgtgcttttatttctcattttcctttcactgaaatgtccccttatgtaattctggaaagaaaatgtaagcttgtgtttctttttttttttttttttttgagactgactctcgctcttgtcaccgcactccagcctgagcgacagagtgagactctgtctccaaaaacaacaacaacaacaacaacaac

SEQ ID NO: 387950 - DNA, 202 bp, Homo sapiens
tgattggactccggtgaagactccaagatggcgatcgccacctcggacaccctgactcagcatttccgggttcacctttcctgttcctgccaccccgactaacgcacatgcccactagggcgtgtcacactcagaagcgtgaaactcaaccgaccctgcccctaccctgaccactcctcacccagcatccataaaagcacgc

SEQ ID NO: 387951 - DNA, 731 bp, Homo sapiens
agcggtataaaagcttttgagggggacttatctgttgccccagaaatggtaatcaagactcaccaatgccaaaaatggatgctcagtttcccctccttataaagaaagttaatgataccctaataggacacagacaagacccttttataattatccattacctaacaccctctgcctgttctagatgaagagaggacaggggagaaaatcaactgttatcagtgtcctttgggctttcaaggagttccgtggttggtggccactccctcttctactaggggtgggactgttctagggcaatgtcttggagagattgagaagtcctgcaagaagagaagactgacacctgattcctcaaatgaatacttctttaattgcaggtgcattttggcattgtcccttgagaaagaattcttgaagatgaggggtttaactaaatctagagatgatggctacatttctggagctttctggagatggaagtcttgctaatagaaagtcttgctaaagatctatggaattgtgtgtcttaaaaaataatggtagggctgggcacggtggctcacgcctgtaatcccagcactttgggagggtgaggcagaaggatcacctgaggtcaggaattcaagaccagcctggtcaacatggtgaaaccctctctctactaaaagtacaaaaattagctgagcgtgctgtaatcccagctactcgggaggctgaggcaggagaat

SEQ ID NO: 387952 - DNA, 448 bp, Homo sapiens
gcagtcaaacccagtaggtcagatcattatttgtgacctgtttctacacaaacaggtgaaacaaaagtagagtcctatttttaggttttgtggctggctgttgggaaagagggttctggtttctaggacctgccttgtggaagagaaattctagtttttatgacgcctgtcaggaggatggaactgagagataggagggcaagaggaggtcagagagaaacttttgcttttgaggctgcctctgaggcctttgttttggggtatcattttctgagtcccaatactggtctactcaaggattagaggaacctgcagcattgcaaagccagtcaacagggaaacctctctatggttatgagtaagctcagctgacctccacagaaccaccttgctgactccctgctggctccagataggtaagtaatacacactcttgtcttcccctgag

SEQ ID NO: 387953 - DNA, 664 bp, Homo sapiens
agtttgtgggtggggcgggggtgaaaaaaaaaggggcctggccgcatcgtctttattttagaaaaaaaactgtttctaaactgtccagctcagatgtgatctcttttatattttgggggattatcataatagaattaaaagagctagatttacagtcagaaaacccagattcaaatctcagttctgttgcctgttggctgtttgatcttgttcttattgaacttcattttccttgtctttggtcaaatattatgaaacctatttttactccttcaccaggcggatgtgaagatccaattagataatttatgtgaatgtgcttagcaaaccacagaacactaaacaaatatagaaattttttcgagaagataatgaggttctctctgggacctattgtaatattttccagcttttcttgccaagaagttccttctatcacacctaaattccgtcgaatttatttccaagcttcagccagcttggaaatagcctttctgttgggacatttccaaatcccaggtttagaggttcttccatctggcaggtgtcaaagaagacaacaggaaccatgagcagaaccacttggaactgcaaactctttgggccaaggagagacttcttctccaggtctggtttggttcgcaaattcctggctgtcatagca

SEQ ID NO: 387954 - DNA, 403 bp, Homo sapiens
ccaacagctcaaccccacatcccaaaggtgttcttcactagccttaaagtgctggcctgagaaaactcaagactgccaaatgaatctgcgttttttccaggcatcacctgaagataaggcccctgtctcctagtctctgtgggaaggcgagaacctagcttggataagcgccagtcaaaaaacccacatggtttcccatggaccaactccactttaccacttttgggaatttttcactttcctaactgagcccctactttcccctctccctaattccttcttttatccttaaaatgcccagtcacttctgtacaactcgaagttgaattttgttcacactggactcttttccctattgaaatagttatcactgattaaaatctgtccttaccactttaactag

SEQ ID NO: 387955 - DNA, 327 bp, Homo sapiens
ttggattatttgagctattgcttcagcctaactcaatgtaaaggggaaatacagaggtaagttttagagtttgggttctctttatggtcattagcagaactgtctagttgagcagccacagattatgttttccattatttattccatcattgtttatcaaggactgtaagggccttgaaattcaactcccccccccatagtttttgtattattccatgtagattttagattattctggagagtgttttgttcttgagcaacagaatactcttgagaagattacgaagtccagtggtatccttttctttgcctaggaaatagagaagc

SEQ ID NO: 387956 - DNA, 466 bp, Homo sapiens
ctatgtgaatttatccagattcacagcttcagctgctaactctacccagatgagtcccaaatctcagtggaaatctcactcctgaactccaaatcttacattcaggtgtctactgaacagcaatacttaatattccataggaccacaaatacagcgtgtccaaaccaaactcagtatctttgccataaaactcaatcctcctcaatatttcttctccagattcccagtaatttaaatatgaaatgtagacttcttccttctcacaagcctcctatatttgatgaggtatcaaattatgtttacttattttttaagtatctcttaaatccactttcttctttctgtctacactgcacctaactaaccttagctcaggccctcaacacctagtgcctagattttagtgataacccctacttctaccattctcctgcataaaacaccttttgtggtgtctgcctagctc

SEQ ID NO: 387957 - DNA, 632 bp, Homo sapiens
ggaaggtggagaaggggtaccactgaagatatgacagaaaaattttagaagaccaaaactaaaagcagttcatgagaaaacaatgtacccttcaatgatgaagttactctggatgatataattttctagaatattttgctattttaggaaaataccaacatatttgttgatattggcttataacaataaatttattaacagctactcacaaattaaagaaatgaaagaagtacgaaaaacttcacagagctaattctaatatgtcttgtattcctgtttttgcctaaatgtaagaatcaatctatataaaatcacataagttctttataaaatggactccacgagtcagtaagttctaagttacatcatcaaagttatcacacagcctttgacataacatttggtaacaaaactactccaataattagcaaacagataatttatagttaatctgtacatatatacgtcaatatatatgcagtaaatgcagtgtaaaattgtatataacttaaagtgttttttttaattttacctgtaactaaaataataaatgacattgcacatccaacagagatttgaatttgacagctgctggacataatttagtaaaattcaaagtaacaaactgggaa

SEQ ID NO: 387958 - DNA, 486 bp, Homo sapiens
cattgtacacttctgcctgggaatccactgattatgttcagatgattttttttccatattggaattgcaattgatctatttgctcatatgttttcaaaatctcccacagaaaatgtatattacttttgaagttagaagttagcaataagagttgttagctaaaaaacagaaacctatttgctatggaagatggcgggttcactcaggggtgcccgatgccatgttagccatgcatctgtccccgcatggtcccgtcctccaccgcctaggagatagtggaccatcagtgcctgaatgcaaatcatagtgagtggtgtgcaggaaagaggttgggcagggcctgtctgaggaggcatcgtgggggccgatccttgaagaatgtgaaagggacaggagaagagcaggcagctctcaggcagaggtgaggggcagtgcaaacgtggagcagtggccccgatcactcagggacgtggcagccttgggaag

SEQ ID NO: 387959 - DNA, 369 bp, Homo sapiens
taagtttctaagaactgaagtgttcaaaagtagaatgaccatctactataattctgaaattatttgttttgtgtgagtcttctcctttccactccttcctcctgtcaccagatccatccttcttcactttgctttaggcccaggaggttaagcacttgtgggtcacattatctgggctctcatcccctggcttccagttggattcagccaatggaaggtctagcaggaatctggaggacaggagaagtcaagatacaccttttctgttccttccctaccctgggtagtgttttctgcagataactgtattatcgcatgattatattgtttatctggtcgtttcaactctcctggctagcctgcttcctc

SEQ ID NO: 387960 - DNA, 2412 bp, Homo sapiens
  misc_feature (702)..(702): n is a, c, g, or t
  misc_feature (705)..(705): n is a, c, g, or t
  misc_feature (710)..(710): n is a, c, g, or t
  misc_feature (716)..(716): n is a, c, g, or t
  misc_feature (721)..(721): n is a, c, g, or t
  misc_feature (729)..(729): n is a, c, g, or t
  misc_feature (738)..(738): n is a, c, g, or t
  misc_feature (740)..(740): n is a, c, g, or t
  misc_feature (742)..(742): n is a, c, g, or t
  misc_feature (744)..(744): n is a, c, g, or t
  misc_feature (751)..(752): n is a, c, g, or t
  misc_feature (758)..(758): n is a, c, g, or t
  misc_feature (767)..(767): n is a, c, g, or t
  misc_feature (771)..(772): n is a, c, g, or t
  misc_feature (778)..(778): n is a, c, g, or t
  misc_feature (787)..(787): n is a, c, g, or t
  misc_feature (790)..(790): n is a, c, g, or t
  misc_feature (802)..(802): n is a, c, g, or t
  misc_feature (805)..(805): n is a, c, g, or t
  misc_feature (811)..(811): n is a, c, g, or t
  misc_feature (814)..(814): n is a, c, g, or t
  misc_feature (841)..(841): n is a, c, g, or t
  misc_feature (854)..(854): n is a, c, g, or t
  misc_feature (878)..(879): n is a, c, g, or t
  misc_feature (881)..(881): n is a, c, g, or t
  misc_feature (889)..(889): n is a, c, g, or t
  misc_feature (903)..(903): n is a, c, g, or t
  misc_feature (930)..(930): n is a, c, g, or t
  misc_feature (934)..(934): n is a, c, g, or t
  misc_feature (957)..(957): n is a, c, g, or t
  misc_feature (975)..(975): n is a, c, g, or t
ccaccaaccagcggctccgcctggccagacagagtgcgcgcgcgcacgttgtgcgcaggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggcgcggcccgcgctgcncgnccccncgcgcnccggncccccccnccccccccngngncnctcggcnnctcccnctcccgccncccnntgcccnctttcggcnctntaataccttccnctnctggcngcntcctttccctcctattcctctcccacnccttccagatttncctcaccacaccctcccccccccnncncttcccgncacccctcccgggnctcccgttcacatcgcctcctcctctnaccnccccaacccctcggcttcgctcntttccccacctcctctcncactgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattccttattactttagacctgtagttttcaacactgacagcactttaaaaatctttgcctgggcctcactcttgagagattctcatttaatagttctgaggtgggtcttggatataactatttttttaaacacctgtcctgtttccctccattcctctcatgtgcagacagggttgagaaccagtagactaatggtcgtttttcctgtttaaaggagataactaatttgagctgaagcaatgcttcttaattagctttgtttttgttttgctctgttggtggctttgttacaactgaattattgtgttattactatttcattgttaaagaaataaagtaagcaatttgtgatgtgagtatcagtgattaagttaactaacttttgtactgcatccagaatgttggttttgcaattgagtaactggttcttgcttgcattttttgttgttgatgacattagatccaaaattcaagacaaatggtaaatgccattgagagggaaagagaaaaacttgattttttttgtgtaatgaaggatttaagaatgggttgacattaataagaatgctttagaacagaagacaaactgtattgcattgtggtcagacatggttcaaagtcttgtactgccacttcctacctatgtatctttaagccagttatttttcatctccaagcctcaaatttctcacctgtaaaatgagaaataataaatagtatctacctcagaaaaaaaaatttattgtca

SEQ ID NO: 387961 - DNA, 944 bp, Homo sapiens
  misc_feature (792)..(792): n is a, c, g, or t
  misc_feature (860)..(860): n is a, c, g, or t
  misc_feature (913)..(913): n is a, c, g, or t
  misc_feature (922)..(922): n is a, c, g, or t
ccaccaaccagcggctccgcctggccagacagagtgcgcgcgcgcacgttgtgcgcaggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggggggcggtggcgacgacggggcggggcgcgcaggacccccgcggggagactggggggtcgcatcgcgccagcacaatgaagaattttgggcagtattaataccttncaatacttggaaggaaatccttttggccttcctaattggatcttgggcaagacatttggaagaatttnaaggtggaaagaccaccccttgacaggaaagccaaccacttttaaggggcaangggaaatgnaaagggggccttgaagggttga

SEQ ID NO: 387962 - DNA, 394 bp, Homo sapiens
gatttcatcgagtacatgaagtacttagatgagacaaaatttaaaatgtatatttgttaaaaatacaaaatagaagattacaaaatcttatatgagtttgcctttaaaacaaatttgttttctgaaaaaaacttaattttttctaagctattgatgctctttgatctctcttttttctctaaagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaag

SEQ ID NO: 387963 - DNA, 2401 bp, Homo sapiens
ccaccaaccagcggctccgcctggccagacagagtgcgcgcgcgcacgttgtgcgcaggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggggggcggtggcgacgacggggcggggcgcgcaggacccccgcggggagactggggggtcgcatcgcgccagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaagtgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattccttattactttagacctgtagttttcaacactgacagcactttaaaaatctttgcctgggcctcactcttgagagattctcatttaatagttctgaggtgggtcttggatataactatttttttaaacacctgtcctgtttccctccattcctctcatgtgcagacagggttgagaaccagtagactaatggtcgtttttcctgtttaaaggagataactaatttgagctgaagcaatgcttcttaattagctttgtttttgttttgctctgttggtggctttgttacaactgaattattgtgttattactatttcattgttaaagaaataaagtaagcaatttgtgatgtgagtatcagtgattaagttaactaacttttgtactgcatccagaatgttggttttgcaattgagtaactggttcttgcttgcattttttgttgttgatgacattagatccaaaattcaagacaaatggtaaatgccattgagagggaaagagaaaaacttgattttttttgtgtaatgaaggatttaagaatgggttgacattaataagaatgctttagaacagaagacaaactgtattgcattgtggtcagacatggttcaaagtcttgtactgccacttcctacctatgtatctttaagccagttatttttcatctccaagcctcaaatttctcacctgtaaaatgagaaataataaatagtatctacctcagaaaaaaaaatttattgtca

SEQ ID NO: 387964 - DNA, 248 bp, Homo sapiens
ctggaatcgcaatggacgagagattgttgcactcgccgaggagccatactcagagcagcaccgaaagcgcaaaatcgacgcagggaccatggcagagccctcggcttcgcccagcaagcgccgtgacagcggggacaacagcgccccgagcggccaggagcgtgaggaccacggtctggagactcggcgtgtgcatgcacacgccgagtcccatacacttcttcaggggggatcctctaaaagtcgac

SEQ ID NO: 387965 - DNA, 393 bp, Homo sapiens
accactacacaatatatctatgtaacaaaactgcattcttaccccttaaattcatacaaataaaaaaaattaaaaaataaataaagtaggacaatcccccagataaataaattaataaataaataaataaataaataaataaataactttagctcttgccttctcctacacataagttaatgtctgatggggttagtggttatgcttctgtaaactataatcagatgtactcttgcacccaaacttagatgcgattttgcgtatactgaatctttgctacctgtatataaactgtggaactgaaatgctgcattggagcagtctgataggatctgtctaaagggctactctgagggctctaggcttcagtctacagtcctcaggaggactgct

SEQ ID NO: 387966 - DNA, 1954 bp, Homo sapiens
  misc_feature (99)..(99): n is a, c, g, or t
taaagaaaataacctgaaaacacttctgacttttccactgtctctttatatgtgctgataggcaaatgtgcatgcacaccaaacataagcatgtttgtnagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttcctttttttttttttggagacagagtcttgctctgtcacccaggcttgagtgcaatggtgtgatcttggctccgtgcaacctccactcccggtttcaagcgatcctcctgcctcagcctcccaagtagctgggattacaggtgcacaccaccatgcccagctaatttgtatattttttagtagagacggggtttcaccacgttggccaggctggccttgaactcctgacctcaagtgatccaccctcctcggcctcccagtgatgggattacaggcgtgagccactgctcctggcccccacttccttttgatttctcagatcagtctttcccttctgagccatggccttctgtgcacccagctcagtggctcttcacccctaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgccatgcagagggcttggggaggtgggtactctccggttggcacttactggggttgattttcccaagagagagggctcttacggggagtgggccaggacctccctggagaagagtccgccactcggtttgtttgcttctggctcttctctctcctcggtgttggggcggcgcctcagagctccggtgtacgcggtctcgccggctcccggggggggggacccaa

SEQ ID NO: 387967 - DNA, 2407 bp, Homo sapiens
  misc_feature (99)..(99): n is a, c, g, or t
  misc_feature (1870)..(1871): n is a, c, g, or t
  misc_feature (1874)..(1875): n is a, c, g, or t
taaagaaaataacctgaaaacacttctgacttttccactgtctctttatatgtgctgataggcaaatgtgcatgcacaccaaacataagcatgtttgtnagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttcctttttttttttttggagacagagtcttgctctgtcacccaggcttgagtgcaatggtgtgatcttggctccgtgcaacctccactcccggtttcaagcgatcctcctgcctcagcctcccaagtagctgggattacaggtgcacaccaccatgcccagctaatttgtatattttttagtagagacggggtttcaccacgttggccaggctggccttgaactcctgacctcaagtgatccaccctcctcggcctcccagtgatgggattacaggcgtgagccactgctcctggcccccacttccttttgatttctcagatcagtctttcccttctgagccatggccttctgtgcacccagctcagtggctcttcacccctaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgccatgcagagggcttggggaggtttgggtactctctgctgccactactgggatgatattcagaagagagaggacctcatactgtgactggacccaggaccctccctggaagagagctcagcccagctgtgtgtgtgtgnntgnntgagtgtgtgtgtgtgtgtttgtgtgctgtgctcatgtgcacctgggtgtaaaatgactgttatctggttgtgttactcagggtgggctggggactcaccagaagaatcccccccagctgcccaagacaggtttttcccttgtaccatcttcagagaggtcaggcgaagagggtccacgtgggttaaggggggtcgtatggataaccactaagaacagactgtgccaggaggagtggcggataaatgaagtggcccaggtctgccacactggttggttttccgtcttcttccctcaagaacgcgctgaaggcttgggactgtgcctgggttcaggagctttgtggctcggtgaacccacgtctgggtggacccggttcctcccttaaagggacgcctcttaccacaaaatgggcagtgcgggttatgagataactagactgggtcgtactttctcacaacgcagcaacatggtcgctacagcaagtctatctctcttgacaaattaccaccgacaagcggcgtcatactcga

SEQ ID NO: 387968 - DNA, 1256 bp, Homo sapiens
  misc_feature (719)..(720): n is a, c, g, or t
  misc_feature (723)..(724): n is a, c, g, or t
gcacaggtgggaccgaagaaaaccaagaagcgttctcacccagtgatccaccctcctcggcctcccagtgatgggattacaggcgtgagccactgctcctggcccccacttccttttgatttctcagatcagtctttcccttctgagccatggccttctgtgcacccagctcagtggctcttcacccctaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgccatgcagagggcttggggaggtttgggtactctctgctgccactactgggatgatattcagaagagagaggacctcatactgtgactggacccaggaccctccctggaagagagctcagcccagctgtgtgtgtgtgnntgnntgagtgtgtgtgtgtgtgtttgtgtgctgtgctcatgtgcacctgggtgtaaaatgactgttatctggttgtgttactcagggtgggctggggactcaccagaagaatcccccccagctgcccaagacaggtttttcccttgtaccatcttcagagaggtcaggcgaagagggtccacgtgggttaaggggggtcgtatggataaccactaagaacagactgtgccaggaggagtggcggataaatgaagtggcccaggtctgccacactggttggttttccgtcttcttccctcaagaacgcgctgaaggcttgggactgtgcctgggttcaggagctttgtggctcggtgaacccacgtctgggtggacccggttcctcccttaaagggacgcctcttaccacaaaatgggcagtgcgggttatgagataactagactgggtcgtactttctcacaacgcagcaacatggtcgctacagcaagtctatctctcttgacaaattaccaccgacaagcggcgtcatactcga

SEQ ID NO: 387969 - DNA, 1160 bp, Homo sapiens
  misc_feature (623)..(624): n is a, c, g, or t
  misc_feature (627)..(628): n is a, c, g, or t
ggtgccccctgggtttatgtgtccatataagtttggagaccccttgttatccccatgagattgatgagtttctgtgcccgtaaaaaaaaaaaaaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgccatgcagagggcttggggaggtttgggtactctctgctgccactactgggatgatattcagaagagagaggacctcatactgtgactggacccaggaccctccctggaagagagctcagcccagctgtgtgtgtgtgnntgnntgagtgtgtgtgtgtgtgtttgtgtgctgtgctcatgtgcacctgggtgtaaaatgactgttatctggttgtgttactcagggtgggctggggactcaccagaagaatcccccccagctgcccaagacaggtttttcccttgtaccatcttcagagaggtcaggcgaagagggtccacgtgggttaaggggggtcgtatggataaccactaagaacagactgtgccaggaggagtggcggataaatgaagtggcccaggtctgccacactggttggttttccgtcttcttccctcaagaacgcgctgaaggcttgggactgtgcctgggttcaggagctttgtggctcggtgaacccacgtctgggtggacccggttcctcccttaaagggacgcctcttaccacaaaatgggcagtgcgggttatgagataactagactgggtcgtactttctcacaacgcagcaacatggtcgctacagcaagtctatctctcttgacaaattaccaccgacaagcggcgtcatactcga

SEQ ID NO: 387970 - DNA, 133 bp, Homo sapiens
aatgacatgagagtaaggttccagagaggcaggagccagatgatggaagagaagtttagtaagagaaatgggaaggcttgaaagattttaaacagctgaatgatctgccttatttataacttcatgttctttt

SEQ ID NO: 387971 - DNA, 232 bp, Homo sapiens
ctaaaaagggatttcagattcataatgaagaaaagtttgttggatattattttctgaaggtcagtagaggcctgtaaagcagaagactgagctaactggtgacatcatgtgggttgctgtggatttatattaacagctgagcttgtatgccttagtctgggctctatgttctaagtaaaataaagtttcagctggtctgaatttgacgttggcattgttattggcgtatgtt

SEQ ID NO: 387972 - DNA, 354 bp, Homo sapiens
aatcatgccagtttggttcggcatttctattgaaatagatgtaaaataaatgtagataaagatatgtaaatatgaatatatactttttacactcctatagggacagacctaacatactaactgtataaactgaaaccaaatacagagtgatctgcttcaatcaagcaactatttatcattcatttagtatttgctaagtttcaggcagtgttctcaatgatgaagacagaaatggggtgctatgccccaagttaatttctaaatctaattaaatatcaattaaaatatcaaaggcattttaagaacattgcaatctatatgcagggataatcaaataataatatatttttaaaa

SEQ ID NO: 387973 - DNA, 494 bp, Homo sapiens
actggatttccgctcctttgggcctgaggggtttcccaagcactgcgtgccaagtgtggattcagcatatgcaggtgacagcagtcaaggctggccacgtgccagcaactggtgctgggcgctggggactccgctgtgaacgagacagtcttggctcctgcagcgctcacaggccctgggaggaacacagtgcagggcagtgggaagagctacagctctgaagtcacagaggctaggcccacatctcagctctggtccttcctagctgtgtgactgtgcacacgtgactcactccctctgagatcagatttcttggtaatcgtaggtaatagtatatataataactaacgtttctagaatgagttctgtgtgccagcaagttaaggctttctctgattctctcatcagtcctaggagggctacgcattgttatctccatcttttttgatgtgaaactgaggcacagagagattaagaagtttgctccagctggg

SEQ ID NO: 387974 - DNA, 342 bp, Homo sapiens
actatgggaaggtgggtgcccccctgtgcccagggtgtgctctgtgtctgtggttctgggcctgagcccggggtgtgtctgtgtctgtggttctgggcctgagcccggggtgtgtctgtgtctgtggttctgggcctgagccgggggtgtgtctgtgtctgtggttctaggcctgagcccggggtgtgtctgtgtctgtggttctgggcctgagcccggggtgtgtctgtgtctgtggttctgggcctgagccgggggtgtgtctgtgtctgtggttctgggcctgagcccggggtgtgtctgtgtccgtggttctgggcctgtgcccggggtgtgtctgtg

SEQ ID NO: 387975 - DNA, 783 bp, Homo sapiens
gacgcgatgtgatttctgcccagtgctctgaatgtcaaagcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctaaaaaaaaacttgctaccaggccaggtgtgatggctcacacctgtaatccccagcactttgggaggccaaggcgggcggatcacctgaggtcaggagttcgagaccagcctggccaacatggcgaaacccca

SEQ ID NO: 387976 - DNA, 420 bp, Homo sapiens
cagcattttactttttcccccctcaaataaaaaaaataaataaaacattctctttcattttaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctaaaaaaaaacttgctaccaggccaggtgtgatggctcacacctgtaatccccagcactttgggaggccaaggcgggcggatcacctgaggtcaggagttcgagaccagcctggccaacatggcgaaacccca

SEQ ID NO: 387977 - DNA, 1324 bp, Homo sapiens
ggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctaaaaaaaaacttgctaccaggccaggtgtgatggctcacacctgtaatccccagcactttgggaggccaaggcgggcggatcacctgaggtcaggagttcgagaccagcctggccaacatggcgaaacccca

SEQ ID NO: 387978 - DNA, 1310 bp, Homo sapiens
ggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggtgagttcaggcagatgatggtgttaaagaaggacagaatcacctcatctctttcatgtctattctctcatgtgaggccatcatgaacacacaacaatctaatctgaagtttgcctttgtccttattgtttcaaagaaaggacactgaggtttgtgttcttcacttaatgattcttacgtctgtgaagtaattcagcatcaactccctgtttagccaaatacacctgaagtcattggtctagaattaaatgaatcagctttataacataatcaaaaagcatttctgccttaaaatgacaccattgatgcctagctcttaccatggcattaatagcaattgact

SEQ ID NO: 387979 - DNA, 1091 bp, Homo sapiens
ttctctctctctctctgtttctttcttgtctcactctgttgcccaagctggaattcagtggcgaaatcatggctcactgcagcaactctgcaggctcaatccatcctccacctcagcctcttgagccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctaaaaaaaaacttgctaccaggccaggtgtgatggctcacacctgtaatccccagcactttgggaggccaaggcgggcggatcacctgaggtcaggagttcgagaccagcctggccaacatggcgaaacccca

SEQ ID NO: 387980 - DNA, 261 bp, Homo sapiens
aacgagtctttaaggaagaacactcagctctctaacattaaaagacacaaaggcaggaaaaccaatacattcacactggagggtggagggtgcagggtgcattcgacaggctccttaggctaggagcgcagagtccaaagagcgcagccctgcctcagatatgggttcctgtgctggaacctcagctactaactttctccttcttctttgagatggagtctccctctgtcgcccaggctggagtgcagtggcacgatctcc

SEQ ID NO: 387981 - DNA, 1857 bp, Homo sapiens
  misc_feature (1469)..(1469): n is a, c, g, or t
cacgccgcccctcctttccctttccgctctctccgcctccggaagcgcggggcgccgggagcccgttcagggccgcgggagtgcgccagcgccgcgcgtggggctgtggtggccgcggctctcaggtgaggggcgcgcgagcggctcctggctccctgctcgcggggcgcccgccacgctcctttccgttcgcatccgtctccccgctccggagcccaggcggcggcgagtactcgggatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccnggaagcaaaagtacaattcctagatcggtgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacggcagatcatcttgggcattagccattagagttcgaatcaggtacgagggccaggggagagaggggggaagggggacctccagtggcctgaaaattaaccttggagtggttaaatttttatgccattggggggtttaacttgtataacaggcgggttttattaaaaggg

SEQ ID NO: 387982 - DNA, 1624 bp, Homo sapiens
  misc_feature (1236)..(1236): n is a, c, g, or t
tccttgtaatccaagcagtcgcagaaaatagaaaatgatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccnggaagcaaaagtacaattcctagatcggtgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacggcagatcatcttgggcattagccattagagttcgaatcaggtacgagggccaggggagagaggggggaagggggacctccagtggcctgaaaattaaccttggagtggttaaatttttatgccattggggggtttaacttgtataacaggcgggttttattaaaaggg

SEQ ID NO: 387983 - DNA, 1744 bp, Homo sapiens
  misc_feature (1356)..(1356): n is a, c, g, or t
cacgccgcccctcctttccctttccgctctctccgcctccggaagcgcggggcgccgggagcccgttcagggccgcgggagtgcgccagcgccgcgcgtggggctgtggtggccgcggctctcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccnggaagcaaaagtacaattcctagatcggtgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacggcagatcatcttgggcattagccattagagttcgaatcaggtacgagggccaggggagagaggggggaagggggacctccagtggcctgaaaattaaccttggagtggttaaatttttatgccattggggggtttaacttgtataacaggcgggttttattaaaaggg

SEQ ID NO: 387984 - DNA, 1727 bp, Homo sapiens
  misc_feature (1339)..(1339): n is a, c, g, or t
atggaaaattttgctgcaggtgtcagcggcgctggtaattcctgagctcagcaaccccgatggataccattatctccatctacacagcggggaactgaagcacaggagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccnggaagcaaaagtacaattcctagatcggtgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacggcagatcatcttgggcattagccattagagttcgaatcaggtacgagggccaggggagagaggggggaagggggacctccagtggcctgaaaattaaccttggagtggttaaatttttatgccattggggggtttaacttgtataacaggcgggttttattaaaaggg

SEQ ID NO: 387985 - DNA, 679 bp, Homo sapiens
agacagggaacgccgggagcaggaccgggcgcggaggctggggccggggacccggggcggcgggtccgagtgggagaaaggagcggcggagggggcctagagttactcgggctcccgggactccccgaagggcagaaataagtttctaaaaataggcagcggcctgccggaagaagctgtgggcggtgcaggagggatccggaagagacgaggcaggaagaaactcctggtcctttcgcttttaaggaacgtgccacctagacaagtgttccagcctccggtgaaccagtcttcctagtgagagcacgagaagcccgttgtccttcattcctcagctatggatttccctgaaagttgagaactgaccatattctcgatgcctcctccgacctgtgatttcatgactcacatcgcttccccagaacctgcttaacagacgggattcctgagaatggagcagagtttgaattcagagtcctggctttgccataccagcagttataattgtccttctgttgtttgatgacctccctgccctgcttcaaaaggaagagaaatcaaagagttgacgaccctgagcgcaaggcctgggacgttcttccccaaactcgctttaatatcaccttctcaaaagaactcttccctgaacaccttgtctcaagatgttctctagtttgtc

SEQ ID NO: 387986 - DNA, 588 bp, Homo sapiens
agacagggaacgccgggagcaggaccgggcgcggaggctggggccggggacccggggcggcgggtccgagtgggagaaaggagcggcggagggggcctagagttactcgggctcccgggactccccgaagggcagaaataagtttctaaaaataggcagcggcctgccggaagaatgttccagcctccggtgaaccagtcttcctagtgagagcacgagaagcccgttgtccttcattcctcagctatggatttccctgaaagttgagaactgaccatattctcgatgcctcctccgacctgtgatttcatgactcacatcgcttccccagaacctgcttaacagacgggattcctgagaatggagcagagtttgaattcagagtcctggctttgccataccagcagttataattgtccttctgttgtttgatgacctccctgccctgcttcaaaaggaagagaaatcaaagagttgacgaccctgagcgcaaggcctgggacgttcttccccaaactcgctttaatatcaccttctcaaaagaactcttccctgaacaccttgtctcaagatgttctctagtttgtc

SEQ ID NO: 387987 - DNA, 326 bp, Homo sapiens
aggccctgggaagagggtcgccggaccagtggggaaggccgtgcaggagatggagagccgggaaccaagaacctgcttaacagacgggattcctgagaatggagcagagtttgaattcagagtcctggctttgccataccagcagttataattgtccttctgttgtttgatgacctccctgccctgcttcaaaaggaagagaaatcaaagagttgacgaccctgagcgcaaggcctgggacgttcttccccaaactcgctttaatatcaccttctcaaaagaactcttccctgaacaccttgtctcaagatgttctctagtttgtc

SEQ ID NO: 387988 - DNA, 811 bp, Homo sapiens
agacagggaacgccgggagcaggaccgggcgcggaggctggggccggggacccggggcggcgggtccgagtgggagaaaggagcggcggagggggcctagagttactcgggctcccgggactccccgaagggcagaaataagtttctaaaaataggcagcggcctgccggaagaagctgtgggcggtgcaggagggatccggaagagacgaggcaggaagaaactcctggtcctttcgcttttaaggaacgtgccacctagacaagaaggcctgggtgtcagccagaccacacatggatccttgagccatcctatgggaatatgacctgagaggcccttcccattgactcagcagcgggatggagaaaccccagcatatcatggtttcgtggactgaaaatccatccggggtcatctgctggggtcctgcctgtgcctcctcaacactcagagtccctaaggtgatgactgcagctatgaccctgctgagagctttctcctgatgccagggcacacttggcccactcactggacaagacagaagtactggagatgttgtactcacagaaatgttgttcagccaatgacagggaattgatgatgatgttagtatcctctccccttgtactggataaacctgagtgttcttgtgtccgggaggtccccagtgggattgagctccagttgtccacagaggggaatttcttcatcacacctgatttcttggcagccttttcctccctgtgtcactccctaatctgttaacggtgttccctgggatcatcccccaaataaactacctggccttgca

SEQ ID NO: 387989 - DNA, 904 bp, Homo sapiens
agcagtcaggccaggtaagagcccctcgccttaactggtttgtgctgaagagacttcttgacttcctgcataggctcccccaccaccaggatgatgggggactcctgtgcagccccactccctctgtcccaaggccaggatctccattcccagtaactcttgcgaggtccccacatcacccaaggctctggctttgtgcaggttcagagtctgcctctcatgcgtgctgtgaccactgcagactcacagactgaggagcggctcagcccttcagtgatgagacggtgcaacatgtttgtggatcagaggagtcagggtcagcagattaattgatccttaattgttgttggggaagttttcttttcctcttccaagtgaatgctatcaacacacttttccaagagtcattttgaattttcctaatttacaactgcaaagcccaccttcctgtccgttgctgaatatcacaaggtctcctattatcctgaatgtctccagatcggctttctgtgactgaggtggagcaaggtgttttctcctatacttgaatgtcaagagttttcatacagctacctgaatatcatgaagcatcatttttcccatctgatcatcaggaactagcatctcacctaccagagtgtgacaaatgcttattgcaaacacctgaatgttaaaacatttcccatcgcctgcaagtgtcaggaggtcacactcttacctgcatgagggcagccttacctcttctacctgaattgccagaggccctcatcgctccacctacaggttaagaattctcacctccaccacccaagtgtcaccctgtcgcactttctctacctgaaaatcaagaggtcttacatcttccagctgaatgtcaagaggttgtattttacctatatgaatg

SEQ ID NO: 387990 - DNA, 793 bp, Homo sapiens
aggtaagagcccctcgccttaactggtttgtgctgaagagacttcttgacttcctgcataggctcccccaccaccaggatgatgggggactcctgtgcagccccactccctctgtcccaaggccaggatctccattcccagtaactcttgcgaggtccccacatcacccaaggctctggctttgtgcaggttcagagtctgcctctcatgcgtgctgtgaccactgcagactcacagactgaggagcggctcagcccttcagtgatgagacggtgcaacatgtttgtggatcagaggagtcagggtcagcagattaattgatccttaattgttgttggggaagttttcttttcctcttccaagtgaatgctatcaacacacttttccaagagtcattttgaattttcctaatttacaactgcaaagcccaccttcctgtccgttgctgaatatcacaaggtctcctattatcctgaatgtctccagatcggctttctgtgactgaggtggagcaaggtgttttctcctatacttgaatgtcaagagttttcatacagctacctgaatatcatgaagcatcatttttcccatctgatcatcaggaactagcatctcacctaccagagtgtgacaaatgcttattgcaaacacctgaatgttaaaacatttcccatcgcctgcaagtgtcaggaggtcacactcttacctgcatgagggcagccttacctcttctacctgaatgtaagatctcaaccagcccgagggtcaataggttgcacatcatctaagtggg

SEQ ID NO: 387991 - DNA, 2512 bp, Homo sapiens
gagcgggtcgggggccgaagcgcctcccgcagggagtccccgtgaggccgcgctgccgcgttacccgcagcggccgggggtccggggagtgcggggctccgagacagagccaggcgccccccagcggtcggcgcgggccccatggctgggccgggcggagcggaaccggtgaggtgaagccccggggccggcagccggaggcgcgtggccggggcgccggctccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtccaaatagtttgggcttttctggcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggaattttatcgcagtgaagctcaagtgggtacccaactgcgttgtaattaacatgattattgggcatgtttttgactctcattttctacaagggctgcagtggggcccaccccaggggctgggcccataactgtatgttatgtggggaaggaagtgtgggggaatgatgggttttccatgaaatgtg

SEQ ID NO: 387992 - DNA, 2610 bp, Homo sapiens
gagcgggtcgggggccgaagcgcctcccgcagggagtccccgtgaggccgcgctgccgcgttacccgcagcggccgggggtccggggagtgcggggctccgagacagagccaggcgccccccagcggtcggcgcgggccccatggctgggccgggcggagcggaaccggtgaggtgaagccccggggccggcagccggaggcgcgtggccggggcgccggctccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctgagggcctgcacaaggagggtgctgttgagaccagaaaagaggccaccggtatctgtgtgggtgctacaatctccagaccatcacaattggttagcagacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtccaaatagtttgggcttttctggcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggaattttatcgcagtgaagctcaagtgggtacccaactgcgttgtaattaacatgattattgggcatgtttttgactctcattttctacaagggctgcagtggggcccaccccaggggctgggcccataactgtatgttatgtggggaaggaagtgtgggggaatgatgggttttccatgaaatgtg

SEQ ID NO: 387993 - DNA, 377 bp, Homo sapiens
ctactactaaattcgcggccgcgtcgacctcctggcctcaagcagtcctcctgcctcagcctcccaaagcactgggatttacaggcatgagccaccgtgcttggccagcaactagcttgttaaggatgtttggcccctactcagtggggttggtaagctcacctcatcctttcctttacaggatctgtggcaaatcctagccccctttgaatccttttcagacttcgtttcccacaacactcctgtcagagttagcaggagagtggaaacaagtactagattatttagtagaccctagattttctctacaaatgtaaaatgttatttttactgttgaaaatcagcatatgtgtagtacagaaaatttaggaagtgga

SEQ ID NO: 387994 - DNA, 385 bp, Homo sapiens
actcctgacctcatgatctacccgcctcggcctgggattacaagcatgagccaccgcccggcctggttgtgtttttataagtcagggtcctttcccagacctccacatacagcactcttttttttttttttaaactaaaagtgtttttttgtatggatgggatctcgctgtgttacccaggctagtcttgaactcctggcctcaagcagtcctcctgcctcagcctcccaaagcactgggatttacaggcatgagccaccgtgcttggccagcaactagcttgttaaggatgtttggcccctactcagtggggttggtaagctcacctcatcctttcctttacaggatctgtggcaaatcctagccccctttgaatccttttcag

SEQ ID NO: 387995 - DNA, 326 bp, Homo sapiens
cctcaagcagtcctcctgcctcagcctcccaaagcactgggatttacaggcatgagccaccgtgcttggccagcaactagcttgttaaggatgtttggcccctactcagtggggttggtaagctcacctcatcctttcctttacaggatctgtggcaaatcctagccccctttgaatccttttcagacttcgtttcccacaacactcctgtcagagttagcaggagagtggaaacaagtactagattatttagtagaccctagattttctctacaaatgtaaaatgttatttttactgttgaaaatcagcatatgtgtagtacaga

SEQ ID NO: 387996 - DNA, 607 bp, Homo sapiens
cttcgggtggcccctcagcatgaccgtccctcaaggctccattctctcttgactccaggattctcccattctgaattttgttgagcctctggctttgggtctgctggtgtacttcccccaggtccaggcaagtcaccttgacttaagtgtcttatttacaacttaaaccaggagtgaccctccctacccgacttccccatttcactgggtaactctgtttaccattgctgtctcaagcattaactatctgtggaagcttctgctcacctttatttttgcaggtatctcttctctttacaatactgctgttttgcaccataaatgatcacaatgccaattttaacatagaaaaagattgttcagggtatatttaaattgctttagaaatactaaaaaattatggcttgtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaattgcgatagagtct

SEQ ID NO: 387997 - DNA, 698 bp, Homo sapiens
cctggactgggttttgtgctggagggtagaaaaaacaaatgctctgaagtacattattgaaacaattgaaaaaactgggatatggcctctggattagatatatataaatattatacacatatatttaaaaatacatactgaaatattaaggggcaaagggatatggtatatgcaacttattcatctgtagttcagaaaaaataaatacacacacagaatgatacagctgtgctgaaatgttgaaattcacaagtctgggtagataaaggatatataggagttgtctggattactctggcgttgtctggattgttctctaagtttgaaataatttcaaagtaaaaggttttttaagtattggagtacagtaaataaatggagcccggctgtctgccaccacttagctgtcttactttggacaagtcactgagcctttctaaccctcagtttccttgcctttcaagtggggataacataatatcagttctttttgcattatagggttgtgtgcatgacaggtattctaactgcaaagatgtgtagacatagctgtgacattttcatctaaacccttccatacctccagggctttgtatggatcataaggctttgttcccttctatgtattagacacttgtgtttataaaccatgaggagatgatactactactaccagtaccattaataataacatcttg

SEQ ID NO: 387998 - DNA, 411 bp, Homo sapiens
acaagctgtgtgaccataggcaagtttgacctttctgagctgccattttctcatggtaaaagagagatactagaggaacctgcctcacaggattgtcatggagaatagaggagatgatacaagtgaagcactaggcagcaccatacttggaactaagggaaagcccgcagtcaatgttcagtattgttacacttgccagattgtgaaagagcgcaggcaacccttgagttgagctcaacgctggagccaagatcaatgacagaaggattttgttttgaaacagcaactaatgaccagagagaggaaatgggtcatgaagctccatggtgcctttcatgaaaatgaatgtaagggagtgattcaggaaaagggaccacgatcaataccagcagactcttcctatgcactggg

SEQ ID NO: 387999 - DNA, 480 bp, Homo sapiens
atctcagctttgccattagctgtaaaactttgggcaagacatttattcttattgacctcatctccagcttgtggatgatcaatgtggaccctgtttctaagagttactgtagaattaaatgatcaattgtgatgaacacatagtaattgctcaattgatattaactagtcatttcttggttccctttcctaagcattatcttcagtctcagataggctcacctcaggctctccacacatgatagcaaaagtgcaaccagcagctcaaaattttttaggtttaaacctgttgtgaagagagctattctgcccccaacaattccaacatacagctcagaaatgggtttcatgcctttgatttgcctgtttcctgttatacatttatctatgacccaagcactgtggcaaggctaatgagattctctgactggcttacataatttcgtctggattaaaggtggagggatcagtcccaacctaa

SEQ ID NO: 388000 - DNA, 435 bp, Homo sapiens
aagctctcaaaaattatttggatgattttttctccctttaggaaagttatgaagagaaagaaaagacagtgatttgtcatcttttaggggagatatatatatatgtgtgtgtcttttaggggatatatatatgtcttttaggggatatgtatatgtgttctaggagataaatacatgtatgtcttttggggtgtatgtatatgtatcttttagggtatatatatatatctcttttaggggatatatatatcccctaaaattatatataaaatatataatttcccatcccccaattggcttatttgactttaatgtttcagcatacttttttgagcctctgctgaatgctgtgcctgtaattgcatagctaagaccttagacagccactgtcagtttaaagtcaatacttaaatacttatagttaatagattactt

SEQ ID NO: 388001 - DNA, 361 bp, Homo sapiens
gttggaacatttggtcttataccttctgtagcagtggttcttaatgaggaatgatcttgccacccaggggatatttgacaaagccagaaaatgtttttggttgttataactggagggcgggtactactgacacaagtgggtagaggccaggaatgttggtaaatatccttcaatgcacaagacagcccccacaacaaaaaaaaaattatctggctcgaattgtcagtagtgcccaagctgagaaaccctgttctgtgcctgtattactctagtgacagttgatcacagctatgttttttaagcactgcagggtcacaaatcatcaaacatacagatgttcagtgtattctgtttactcagg

SEQ ID NO: 388002 - DNA, 192 bp, Homo sapiens
tgctcttcctaccttgatcaccccccaatacataaatacatatttccacttcaagacgaaaggaaagcagactttccttgccatcttgagtagctagcaatgtgcacacagcttttgtgttttgtttttttttttttgagatggagttttgtttttgtggccctgctcttgtggcacagactagagtgcaat

SEQ ID NO: 388003 - DNA, 312 bp, Homo sapiens
ggggaactcattcaccatctaccgccccatgaataaggaaaaactcagacaaaaaaagaaataaaaataaattaggactgggtccatatgtttgtagttaaaaaaagaaagtttcaggctgggcacagtggctcatgcctgtaattcaattccagccctttgggaagctgaggcaggaggatcagttgggcccaagagttcaagaccagcctggaaaacacagctagactccacctccacaaaaataaaaaaattagccagttgttgtggcacacacctgtagtccctgctattcaggaggctgaggcagaa

SEQ ID NO: 388004 - DNA, 202 bp, Homo sapiens
ctggattccttggcctctgtcctgaggtgtgagctcaatggtcaggagtcacagagacatactttgctgctggggaacagagggagcacatacctgttgtcccatgttgcctgtgtatgaataaggcccaggaatccagggccctaagaggcctccctgcagctctcctccccgtccctctgcagcctccctgtccacacag

SEQ ID NO: 388005 - DNA, 765 bp, Homo sapiens
atttggacatcaaacaagagaagaaggacctttaatgaaataacttacattttttctaccaatatcccatcagccgaaactactctctctccccactcctccaacactctggaatataaaacagatttatgagtaaccaccactctgttaggtgcactttgaatttagttctttcaaagagaaacgggaatgggactgtagccacctcaagaaatgatactggcaaaagacacatttggtattcctattttattgccacaatatgctgaattttgtctatattaaggaaaaggtttcagccaacaacctgcgtcaacaaccacacatgtgaggaaagatgtcttctgaagattccagcctccagccagcaagcctttccaagtataaccctaggacacaaatcaaaattactcagaatttgaagagccaggaaaatatcaacttgagtgggaaaaggcaatcaacatatgccctttattgtgcaaaactcgggtaacaggtaaacaagattaacagggaccgctaggatcaagaaatggaagatgcctccctacatacatctgagatgaatccacaaagatatcaatgcctcaagagccttgccgaattccacctgctgtcctgggatctccgccttccccatagaaccaagcgtgggctagtcccctggaggatgagatctcacatagtccataatcaaatgggtctccttcctagccagtaatactgcagacaaacgagagttccaggtgagaccaggagaag

SEQ ID NO: 388006 - DNA, 1098 bp, Homo sapiens
gactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcat

SEQ ID NO: 388007 - DNA, 386 bp, Homo sapiens
ctttactgtgctttccttgaattgcaagtctgattacttgcaacattctctttgtattatgttttgtggcttgagtgtgcctaatccagccagaggtaaagctggggaattgtcctcttctttggtcttgaggcacttctgcaggaaaatttagctttagaaaagataaggttaccaaagttctgactgcctagtttgtgagctgggcccctagtgtcatcatagggagctatggtttcattattacacattttgtttttcactaaatatcatagtttttttctctgaaatgctaatgagctgtcatgtggctatatttgccttcaagttactgggaggattgatagtgtctgttacaggcaaaacaaagctctgttttttttaat

SEQ ID NO: 388008 - DNA, 362 bp, Homo sapiens
gggtacaggtttaagtaggatggtcaagaaaggttttatttatacagtaactgttttcacaaagttatgaaaaaagttagggaacagataggcagatacctggtgaagacgattacaggcatgagccactgcacccggctcttcctcttcttataaggacattaatcccatcaggttagcagggcccacactcatgacctgcacccagtaggcctctcctcccatgcttccagcttcagtgaaagacaccagcatcaacttaggacccgggacctgcgtgtcaccctcgactgaattattggagtgttctcaggagggagactaggtaagttagggctgtgagctcagctgctgtccagctt

SEQ ID NO: 388009 - DNA, 1830 bp, Homo sapiens
  misc_feature (789)..(789): n is a, c, g, or t
agttctttggtattagcacaagtaacacaaatcgattaaaatctaagctaaccattatcattttttaccatttgtgttggctcttcatcagatcttagctttaaatgctaaaattcactggctctgagataaccacaaatcagtctctgcttttgttcttaaaatactctttaattttttaaaaggcaaccaacaagagttggggatctcctttagatctgtttgttgaaccaccaattcattagtccagtgaacaaaaatgtatgtagttactgctgtgtggcaggcattcgtctaggcacagaaaatcatgggatgataaaacatttctgtccttacggagcttacattttagtgaacagtgacaggaaatgaagaaaatgactgttaatagtagttaactaggaggctgctttagattgggtggacaggacttgtccctttaaattacttaatcttcacctgaatataaaaaaggagtaaggcatacacatagctgagaagcaagtatttcagggaaaagaaacagcgaaagtcagctgagtgcaaagtgtgctggggaactgtgcagagtctagtgatctttggaaagaagggcaggagggagaggctggaaagagaccatgcaggcccctggcgaggagtttgggattaattacgctcccagtgggaggttgctggagtatttgagacgtctacttgaccatttaaaaataccatattggctgtgacattgagaaagggggtcaccagattgatggagacaaatggcagatgtgggttattgcnaatggagagtcaagactgtgaaggatggagaaaggaaacaatcatgaatctttggtttggattttaaataattaggggatgctggaaccatttactgagatggagaggctgaagaaaagcaggtttaagatttatgtgatgtttaagatcttattaatgcttgtcatcttcagcagttatacgagcaagtctggaactgaaggcaaaggatggggcttgagatttacatttggagttatctgtgtgtggattggaattaatgccatgggattaggccacattgcttaggatggtgtagaaacgcaaattccttcaacatttggaagcagttttattgtcctgctgtagaatttcagataactgagaatctgccactactttgagccgctgcattttctgagctctgatgtcattcagaaaaaatggaaagaaactagtatttgttgaaagcctaatgtgtatgcaaaattgagcaagacactctttacatgttatttcatttaatcttcaccacgattctcttaaaatgtgaagaaactggctcagagttaactaaataagtagaaaagaaggtaatgtgactgagaagtgactccaggatttaaatccaggttgttcagtgttcttttgctttattgggcttgcagttggcagagttgcaatgacatttattttattttgatagctcttgcaaattatatggaattttaaagtgaatataacatctcccatatatatgttttaaaactttcaaaacaatatttgctcatggcaaagacaagaaaacgcctcaacaaggttttaaggtgggatttactctcatccctttctctttaaataccatttcctttccacaaattctagaaatttccaagcctattgtagaagagaaaagatatctttccttacccaccactaagttcatagctgagactcctataacaaaatacaaattaacaagagaaaagcatacaaatttatttaatgtaagttttatgtgacacaggagccttaagaatgaagaagcccctcccccaactc

SEQ ID NO: 388010 - DNA, 1538 bp, Homo sapiens
  misc_feature (497)..(497): n is a, c, g, or t
ctctagagatcctaaagcatactccccgaaaacatttctgtccttacggagcttacattttagtgaacagtgacaggaaatgaagaaaatgactgttaatagtagttaactaggaggctgctttagattgggtggacaggacttgtccctttaaattacttaatcttcacctgaatataaaaaaggagtaaggcatacacatagctgagaagcaagtatttcagggaaaagaaacagcgaaagtcagctgagtgcaaagtgtgctggggaactgtgcagagtctagtgatctttggaaagaagggcaggagggagaggctggaaagagaccatgcaggcccctggcgaggagtttgggattaattacgctcccagtgggaggttgctggagtatttgagacgtctacttgaccatttaaaaataccatattggctgtgacattgagaaagggggtcaccagattgatggagacaaatggcagatgtgggttattgcnaatggagagtcaagactgtgaaggatggagaaaggaaacaatcatgaatctttggtttggattttaaataattaggggatgctggaaccatttactgagatggagaggctgaagaaaagcaggtttaagatttatgtgatgtttaagatcttattaatgcttgtcatcttcagcagttatacgagcaagtctggaactgaaggcaaaggatggggcttgagatttacatttggagttatctgtgtgtggattggaattaatgccatgggattaggccacattgcttaggatggtgtagaaacgcaaattccttcaacatttggaagcagttttattgtcctgctgtagaatttcagataactgagaatctgccactactttgagccgctgcattttctgagctctgatgtcattcagaaaaaatggaaagaaactagtatttgttgaaagcctaatgtgtatgcaaaattgagcaagacactctttacatgttatttcatttaatcttcaccacgattctcttaaaatgtgaagaaactggctcagagttaactaaataagtagaaaagaaggtaatgtgactgagaagtgactccaggatttaaatccaggttgttcagtgttcttttgctttattgggcttgcagttggcagagttgcaatgacatttattttattttgatagctcttgcaaattatatggaattttaaagtgaatataacatctcccatatatatgttttaaaactttcaaaacaatatttgctcatggcaaagacaagaaaacgcctcaacaaggttttaaggtgggatttactctcatccctttctctttaaataccatttcctttccacaaattctagaaatttccaagcctattgtagaagagaaaagatatctttccttacccaccactaagttcatagctgagactcctataacaaaatacaaattaacaagagaaaagcatacaaatttatttaatgtaagttttatgtgacacaggagccttaagaatgaagaagcccctcccccaactc

SEQ ID NO: 388011 - DNA, 485 bp, Homo sapiens
ctcctggcctcaagcaatctttctaccttgacctcccaaagtgctgggattacaggtgtgagccactgtgtttagcctagacttacctttaatagcttttgataagttattttttaatgtaattttgataaaataattgtacctaaaatgtactaatgtgttggtattgtctactatccaatctacgaacaaattttactgattcattcgtaactgaccccagagttggtttgtttgaatcactgtaactgagcctctattataaagatcatacgatgtttgttttacctactttccctttccccttgtccttttcttgctctatgcgtgcttgcttgcatgtcattatttcagtagagggtagtcactaataattgattaacttcatatcctaacctacaggggtgcctggcagattgatgaacttgtttttcttttaaagaaccatgatccttaggttatgcagacctccttgatggtgtcca

SEQ ID NO: 388012 - DNA, 364 bp, Homo sapiens
ataagttaaagagatttatggtacaacatagtgactgtagttaataatgtattttcaaaaaatctctaaaagaatagattttaactgttctcaacacagaaaattaaaagtatgtgaggtaatgcttatatgttaattagctggttttagccattctacagcatatacttacttcaaaacaccatgttgaacaccataaatatatgcagtttttgtcaattaaaaaataaaatttttatgaaaggaacttcaaatgctaaatgaggaatcctgcctgtaaatcatgctctatgattccataagacattctggaaaaagacaactttggaagcagtaaagattagtgcttgctacccagaggaaa

SEQ ID NO: 388013 - DNA, 237 bp, Homo sapiens
tgttgtgacagtctggattttgtcttccttgaggagtgtcaagtcttgtgctggcaggcagttaatttactcacagttctgcttgatcctgttgaggcttagtttggggcaaattaaggtacccctattcgcaaggcatggcctttttggggtttcagctgaatgcttgaggtgttcagcaaggtctggctctgctatttggccagaattccaatgtcttccagagctgaatacctt

SEQ ID NO: 388014 - DNA, 379 bp, Homo sapiens
ttacttaaagaatgggaaggactttggacagaaaagagggagggaccctagatgaaaggctgtggaggcggcaaggaaaatgtacaacttgaaatgtctgggcagtggcaagaccagcctcagggctggaagagaggatgcaaagagggacggggagatggtgagaccaagctgcaggtggggtccgaagtcggggtgcggccagatttaaaaggacactgtaggctccgcctctcttctccctttgcctctactgagagcctcctccttgcttcttgcctctctcttgcccacaggcccctcttcctgcagtctgttggagacctcccatctcagactccctgcttccttctccagacactccttatctctctgtgcc

SEQ ID NO: 388015 - DNA, 354 bp, Homo sapiens
gacagaggagaataaatggaataacttagttttgtgaaagactcacagtatcacttggtttctggacacggttcgagacctggctgtggcttgctgtggccttgagagccatcccacagcagcaatgctgttggaccctttggctgggaccttcaggaccccctgcaacagcactgtgtgccctaacctgctggcatgatgcccctttgttgacagggctgcatacaaggccagcgacaagtggcaggcagtgacgccagcctgatttgctgagggcacacgccatgcttcctgcagtgccagtgctcttctgggtccactttgcagcaggatagatgtgttctagatccaaga

SEQ ID NO: 388016 - DNA, 399 bp, Homo sapiens
ttggtaaagggaagaggggaggagagggaaaagtaagcttgttttttgtttgctcgtttgtttttcaaatttatcttaaaaggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggtaacagagcaccataaggcctgtacttttaaggatgcttatgactttctgcatgcttacctattattgactcaatatatgttctcattgttaaattttctatctaaccatagcctaatttcacaattcaagttaagagcta

SEQ ID NO: 388017 - DNA, 934 bp, Homo sapiens
agtgcttaccccccctcaaaaaaaaaaaagtggggggcaggacaaatggctaagcagtgtttggaccgcaggatgaacaatcaataggcagaaagcaagattgaggcttcctcagcttttggatcgacaatcgacagctgagaggctattttttgctatggttgactaaatatggtcagggaagagagaggcacaagagagcctgtttgcctgggagtgcatgtttcaaatgcttagctgcctataaagctgtaacagtttagccagtggtgactgaggaagaatataagttagcctcgtagtgaccatgtggaagtcctgacctcgcttgcagacttgacctctggatgtgacaaggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcagttactatcatactatgagaaaacatcaagatcagctttgaaatctagactcatattgatctgcacctttgaaatagagacttcaaaggacagtcttcaaaaatataggacatctagacacttcatcaggttctggaaataacaacgtgctatatctggttttcttttcttttctttcttt

SEQ ID NO: 388018 - DNA, 1249 bp, Homo sapiens
agtgcttaccccccctcaaaaaaaaaaaagtggggggcaggacaaatggctaagcagtgtttggaccgcaggatgaacaatcaataggcagaaagcaagattgaggcttcctcagcttttggatcgacaatcgacagctgagaggctattttttgctatggttgactaaatatggtcagggaagagagaggcacaagagagcctgtttgcctgggagtgcatgtttcaaatgcttagctgcctataaagctgtaacagtttagccagtggtgactgaggaagaatataagttagcctcgtagtgaccatgtggaagtcctgacctcgcttgcagacttgacctctggatgtgacaaggtagcttcactacagctctactatttaatcctggaaactaaaaaccaaaaaaaaaaaaaaaaaaatctaaaagcaagaaagatgcagactatttcctaagaagtcagaagaacccaatgtattctggagggcaaagaaaaacagggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatacctactcagagtacatacttctttatgtacccatatgaacatacaatgctatggaatgtaaagaagtatgtatttttggtaggcaataaaccaccaagggagaattaaactgagctaaaagaagctcttgcttctttctacgtgaatgaccgtcatatggtaaattaacctagtcatgaacagatgacctttggcaatactaacacc

SEQ ID NO: 388019 - DNA, 1050 bp, Homo sapiens
agtgcttaccccccctcaaaaaaaaaaaagtggggggcaggacaaatggctaagcagtgtttggaccgcaggatgaacaatcaataggcagaaagcaagattgaggcttcctcagcttttggatcgacaatcgacagctgagaggctattttttgctatggttgactaaatatggtcagggaagagagaggcacaagagagcctgtttgcctgggagtgcatgtttcaaatgcttagctgcctataaagctgtaacagtttagccagtggtgactgaggaagaatataagttagcctcgtagtgaccatgtggaagtcctgacctcgcttgcagacttgacctctggatgtgacaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatacctactcagagtacatacttctttatgtacccatatgaacatacaatgctatggaatgtaaagaagtatgtatttttggtaggcaataaaccaccaagggagaattaaactgagctaaaagaagctcttgcttctttctacgtgaatgaccgtcatatggtaaattaacctagtcatgaacagatgacctttggcaatactaacacc

SEQ ID NO: 388020 - DNA, 2620 bp, Homo sapiens
agcggaggacgccactgccctgtcgccccgcctgtgcagcccaggagctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggttagtggaccattctagaataccttgccatatttcttttcaactggctatttcccaaggatcatgtaagagaagctgggcagaaagataaaaagattacatcagtcatgattcatgaaccagtcatgaatcagttgacaacaaatttattgcacagaatatttctgtattttgtcaagctacttttaatatttaattcttttacttgataaaatgcaagtatattaagaaataagtatactgtgatgaattaatctatatatatgaacaaacctggtataaaatgaatgtaatctatgaacctttagagcttagactgtatttcacacaaataattgtcatgttttgttgctattgtgaattataaaaatgcagcatttaaaatttttaaggcaaaatttaataaaggatatacagtaaaaaaaaa

SEQ ID NO: 388021 - DNA, 1097 bp, Homo sapiens
agcggaggacgccactgccctgtcgccccgcctgtgcagcccaggagctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacaggttgctgttatttgtatttttctaattttttatattatgtgaaagaatatcaatgaacattatgtacttgagataaattagtggttactgttttaagggcttttataaacatgtggaaacaatttttaaataatttgacatattaatttttttaacttgagtcaaatgtgtgtttgtgtaagtttttaagagaagcatatttggaagaaaaaggattttttttgcctcaccatacacaatttctgagctattatcagaatggagtactttgactacagagaacctttacctggcttttggttttggtttcttcttccatcacctttattttcccaaaaatcaaattaaaggaagaaattgggttggagggaggatgttatataacttgag

SEQ ID NO: 388022 - DNA, 641 bp, Homo sapiens
  misc_feature (1)..(1): n is a, c, g, or t
  misc_feature (16)..(16): n is a, c, g, or t
  misc_feature (22)..(22): n is a, c, g, or t
  misc_feature (28)..(28): n is a, c, g, or t
  misc_feature (35)..(35): n is a, c, g, or t
  misc_feature (44)..(44): n is a, c, g, or t
  misc_feature (54)..(54): n is a, c, g, or t
  misc_feature (80)..(80): n is a, c, g, or t
  misc_feature (85)..(85): n is a, c, g, or t
  misc_feature (87)..(88): n is a, c, g, or t
  misc_feature (95)..(95): n is a, c, g, or t
  misc_feature (103)..(103): n is a, c, g, or t
  misc_feature (117)..(117): n is a, c, g, or t
  misc_feature (130)..(130): n is a, c, g, or t
  misc_feature (136)..(136): n is a, c, g, or t
  misc_feature (146)..(146): n is a, c, g, or t
  misc_feature (163)..(163): n is a, c, g, or t
  misc_feature (168)..(168): n is a, c, g, or t
  misc_feature (176)..(176): n is a, c, g, or t
  misc_feature (180)..(180): n is a, c, g, or t
  misc_feature (188)..(188): n is a, c, g, or t
  misc_feature (196)..(196): n is a, c, g, or t
  misc_feature (214)..(214): n is a, c, g, or t
  misc_feature (219)..(220): n is a, c, g, or t
  misc_feature (223)..(223): n is a, c, g, or t
  misc_feature (227)..(227): n is a, c, g, or t
  misc_feature (229)..(229): n is a, c, g, or t
  misc_feature (234)..(234): n is a, c, g, or t
  misc_feature (243)..(243): n is a, c, g, or t
  misc_feature (252)..(252): n is a, c, g, or t
  misc_feature (258)..(258): n is a, c, g, or t
  misc_feature (266)..(266): n is a, c, g, or t
  misc_feature (270)..(270): n is a, c, g, or t
  misc_feature (302)..(303): n is a, c, g, or t
  misc_feature (306)..(306): n is a, c, g, or t
  misc_feature (322)..(323): n is a, c, g, or t
ntgttgctcttctttntttttncttttnttgtttntttttgttntttttttttnttttttgtctttttggcttcttgttnttttntnnttttttnttttttcntatttttttttttnatgggtttttttnttttgntttttttttngcattcagtttttggtnttttngctttttntttntttgttgngctttctnacgaatttttttgttttnttgtnnttntttntnttttnctttttttnttttttttntttttntgcattgntttntatttttttttttttttttatattatttattnnttntttgtttttgtgcttnntttttgttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 388023 - DNA, 3791 bp, Homo sapiens
agcggaggacgccactgccctgtcgccccgcctgtgcagcccaggagctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtaatcaggattttatttttcacaaatcaactatgtgttttaatagtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaatttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 388024 - DNA, 324 bp, Homo sapiens
gaactcttagagaaaacataatttatgaacatttttaggttttccatctcaaccttctttttttttaatattgactatagagtgatgttccaatagatttacttgatgtggataaaaattctgctgttgttagctttagcagctgtgattctgaggtgagtaaaaatataaaagaattcttcacatgctttcatttctattatgccattttgattaaagtctatagatgctgctaggttttgatgtttctttttcaattatttcttatgtaacctttccttcaaaatctgtgtcggttctctttccctgtcctcagtcgagaaa

SEQ ID NO: 388025 - DNA, 3746 bp, Homo sapiens
agcggaggacgccactgccctgtcgccccgcctgtgcagcccaggagctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaatttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 388026 - DNA, 3713 bp, Homo sapiens
  misc_feature (19)..(19): n is a, c, g, or t
ccaatgcaggctggtacgncctggagtaatgggatggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaatttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 388027 - DNA, 552 bp, Homo sapiens
agctgggactacaggcacctgccaccacgcccggctaattttttgtctttttttggtagaggtggagtttcaccgtgttagccaggatggtctcgatctcctgaccttgtgatccgcccgcctcagcctcccaaagtgctaggattacaggcgtgagccactgcctttgttacttttcttaatcagttctcatgcgctcatccacccctaagcctggagcctcaggagatcactgatatactgtctatcactagatgattagattggccttttctgaaacgtcatctaagtggaatcatatagtgtactggatacccttcttttttttgatcagtgttatgtttttgagacttgtccttattgcatgtgtgggtagcccattactttttattcctgagtagtattccattgtatggatatgctgtcatttatggctgttttgagtaaagctgctatgaacatccacatacaggtctttgtgtggacatgtgttttcatttcttttgggtaaatacctaggagtagaatttctcggtcatatgagaagtgtgt

SEQ ID NO: 388028 - DNA, 276 bp, Homo sapiens
cttctttccacccctcccctggattggagaagagatacgttattgcccaccacatgggcagtaactccctaggaggtgacagagcaacaggataaaaggaacctgggtccttggataacttcatgaaatagagttgccttttctctgtggctctcccacttaactctggactattatatgagaaataaataaactaaattgtttgaaaaataaataaaagatgaatagggagggagtgactacaaaagttgcttatcaggaattctaattggttta

SEQ ID NO: 388029 - DNA, 1729 bp, Homo sapiens
cgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtctatcagccacagtctctgcaagtttccaagagcagcagaaaatgaacacattgcaggtgagttttcctgcttgtgtatatgttcctcaattttattttatgatgcattttaagaggtttgtaaggattcatacttttttttttcttttttttgagatggagtcttgctctgttgcccaggctgcagtgcagtggcatgatctcgcttcactgcaacctccacctcctgggttcaagtgattctcctgcctcagcctcctgagtagcagggattacaggcgtgcgccaccatgcccagctaattttttgtatttttagaagagatggggtttcactatgttggccaggctggtctcaaactcctgacctcaggtgatcttcccacctcagcctcccaaagtgctgggattacaggcatgagccaccaagcccagccaggattcatactttaaaatgggaatgtggaaatagacattatcctgtaaaatatagttagtgtggcagatcagcaccaaaaatgatttgtgaagcttgtatgtatgggtagtatattttaaggctgttgaaattgagccgcacctaggactgatattcttggcagtcatcacaaaaggaaagtgccatctgtattagtccattctcacactgctatagagaaataaccaagactgggtaatttataaagtaaagaggtttaattggctcacgtctgcaggctctatcataggaagcatggctgaggaggcctcaggaaacttacagtcaggtgaaaggtgaagggaaagcgggcgcatcttccatcaccagagcaggaggaagagggaacactggggattacaattgaacatgagatttgggaggcaacacacaccgaaaccatatcaccatccatgacatcgtttgcattgattataaggagaaaccagttttgttacttgtggatttaaaagattttctgggacttggaaaaatttcttcattcaagttggtgtaattgtggatagctttcctaacaacaaccattaattactgtaacttatggcttattcttggtgcttatgtaagcagagggcctgctgcccaaggagaacttggtgcatataatttttccagggacggaaatatcgtgatccaagtaaacaattctgtttttactgttgagtcctagatcatggggggaatgaatgacgtgatcatccgtcaaatatttgttcgtctttttgttcgggttgcacagcaaacaatacagacagttactctcttgtgaagatttcctcatttctgtttctcatttcacttctcagtgttttcgttttgtcctcaataaattaggtattgatgggacgtatttcaaaataataagagctatctatgacaaacccacagccaatatcatactgaatgggcaaaa

SEQ ID NO: 388030 - DNA, 789 bp, Homo sapiens
caaattattaggaaatgtaatttagatttaaaaggcctctgttgtttacaaatgaattctaatcaggtaggtactagcagctcctcagggaggtaaaagctatcatttagaatgtggctgccctttctgggtagctttttgttttttctgatcataatggcatgcaaaaagataatacaagaaagtaccaatgctaaggcttacattggtaaagagagagagaatattactcttcagcaattgttcattgttatcagtactggatttgattacggatataggatttatagctctaaatttggagctctaaagaaacctttagttttgaaataactgtaagaatttgtaactcttgagtttccaatattaaatcattttcccaacttttaaaagttagattctccttttatccataaaatggtcctgaatacttgaagtttattataatcacatatctcatgttaaaacaaaaaaaaagctacaatccctgaactaacaattttctttttggggattctgggcaagagggctgactagaagcagctaatatgcaccaatttcaaggagagaagacagtgtgatcagtaaacactagctcttcaactagatcatccaagagtaaacttcggaattcatgaagaaaacaacacaacccacagagaatggagaagcgtgagatatgacaattgcccacccggagtggtacagagccaggggaggcccccacttcgggaaaatggtcagtgagtgagggtccctggggaccacacttctgccatggaccccttt

SEQ ID NO: 388031 - DNA, 888 bp, Homo sapiens
cgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtgagccccagggaggcggatctgggccccgagaaggacacccacctggatttgccccataggcccggcccgggcccctcgggagcagaacagccttggtgaggtggacaggaggggacctcgtgagcagacgcgtgcgccagcgacagcagcccgccccggcctctcaggagccgtggggcagaggctgcggagccccaggagggccggagccctcatgacttcagtgacctgcttctgcccctctaggtctatcagccacagtctctgcaagtttccaagagcagcagaaaatgaacacattgcagagggctgactagaagcagctaatatgcaccaatttcaaggagagaagacagtgtgatcagtaaacactagctcttcaactagatcatccaagagtaaacttcggaattcatgaagaaaacaacacaacccacagagaatggagaagcgtgagatatgacaattgcccacccggagtggtacagagccaggggaggcccccacttcgggaaaatggtcagtgagtgagggtccctggggaccacacttctgccatggaccccttt

SEQ ID NO: 388032 - DNA, 137 bp, Homo sapiens
gctctcaggacttaatcacgtgcattgtgcctggcctcttgtttagaggtttgaaacatgacctcttgacttcctattttagtaaatcaggttaagttcagctctatcccacttcctactttttttttttttttttg

SEQ ID NO: 388033 - DNA, 834 bp, Homo sapiens
gttttttgtttgtttgtttgttttttgagacggagtttcaatcttgttgcccaggctggagtgcaatggcatgatctagtctcaccacaacctccgcctcccgggttcaagcgattctcctgcctgagcctccccagtagctgggactacaggccaggcattccctgccagcagcttaagcaccatgagttttgtcactgtctttgatgtgcctctgaaatgatgagcaactcttggaaaatgccaaacaaaacaaagtgtgaccttccctcaactcacacagcatcggattcttggaaaaccctttgtatattaaaaccttgtggaaaaccctgtgtttatatataagacagaggtgggctccagtctcagatcatcatgacgaaagtgaggtttgcgcagcataaatgtccagcaggacacatggagctcatgtggggtttggggtgatgcttggtcatacaggatctgcccagagccttgtttccctggcagggcccctcatgtgtcaggagcaccacccttccagtcactgaggcaaaccctcctccccacgaatttccagaaagtcctgggggagatactgctcccaaggagatgccctgttccagacccctcccagctctcatgaggccttacatcccactggccacggcagcctcaccctgggactacgaggtgcccacccctgtgggtttggacttggaggctgccaggtcagcacactggcccatgccccagccctcagaagggtggtgccagggttcccgtctgcaagtgcccagccagcctgtaaccttcctggctccctcccctggagcttctgggctcaca

SEQ ID NO: 388034 - DNA, 1495 bp, Homo sapiens
gacatttgctagaagctctctgatgtccaccccctgtgctgaatttgctcctattgctgtttctgagagagagggagaatgtctgtatgtacaaattggtaaacctcaggtttatgaatataagaaagtacaagtcggatagactaatggaaaaaaaactcaaaggatttagagtttagatttgggacccattcttggattaagtcccaaacctgtttacttatctgtaagatgtagctggctaagggtgttgcttctgagcttcaactaagataatatgtcaaagaacatagtaagccatgagatgctatataaatgtggactaatttactctgtgggcaggattatttgtatagatgtgcaaagggccaggtcttcccaaatacagccagctgcatcttagttggtgctattcacacagtatgaggattttattacttttagtttcctcttgctatcctgacagaaattataccaactagagattcacttggattaataaatgtatacttagttatacatttttcgaggactgttgaaatgatggtcatattttagtttaaatggtttccttttagcagcgtactataatgcaagaaaagttaagacactaagcttttaggatcaaatttggattgaaattctaacttcggaacttaccagccaaattaccttgaaaaaattacatagcctttctgaacaacggttttgttttttgctctaataccgtcaaccttaagccttgtgggaaaggtaaactgagaacatatggtttggcacttaacatacgcctagcactgggtagggattgctaaatggtttcctctgctaacaagaatacacagcttggaacagctgcactgaggaaatgagtgtttcagaactccgttttgaaaactggttggaacaagcatgaaagatcaatggacacttatgtcactgtcaaccttgtcttctgaaatatacaataacatagaaaaaagtcaaaaccagcattgaactacccaatctttaatgcaaatgcaatggagagggaaagtaggcaaattggaacacagcccactatttctgggtgatagtagaccctaatgaacagtttagagcagcatcagggcagagagtgaggcagaggtgggaactagaaagaggctgatggaaaatagagtggtgagatgttgcccaaaactgcttttttctttgtttcagagtattacctaggattgattcagtgcttggagcatggcccttctgcttccatgacccagaatttagatttgttccatgatgctgcaagatggccattataggttaagaaacctttggtagactcttctgggaatctaatcataactcatattgcttgtcagtaatatttaagcctaaataatggtcagacttaaacatatcccctttgggaacatgaccaatctgtatttgggaataaacaatatttaaagttttcatattttggtttcccacttaaccaaatgtatat

SEQ ID NO: 388035 - DNA, 309 bp, Homo sapiens
aaaatggaacaaactccaagaatttgtaaaggcacagaccagtgtacccagtgtgctaggatttgtgcagaaaaataagaaaatgcatgtgcgagtgtctgtgtatatgtgcatttgttgtgggtgaacagaatacttccagaatgagacccaatcagccagtcagtgccttggtctcggggaagcagaacctcttggcttggagacagttttgaatgtaggaccctgttcacgtttaaactaaccccaaacaaataatatgtaaatttaaaaagaaaagaaagtcgcgtgggcactggagtctcacgg

SEQ ID NO: 388036 - DNA, 624 bp, Homo sapiens
attttttgagatggtgtcttgctctgtcacccaggctggagtgcagtgttgccatcttggctcactgcaaccttcgcctcccgggttcaagtgattctcctgccctcagcctcccgagtagatgggattacaggtgcacaccaccgtacctggctaattttttggtattttcagtagagacaggatttcagcatgttggccaggttgatctcaaactcctgaactcaggtgatccacccgcctcagcctcctaaagtgctgggtttacagccgtgagccaccgcgcatagccactttagattaactttacttatctactgtcattcagtatctactgaactcctacagcgtgtagtcactgtgctaggcagggctagcaatacagaattgatagactgctgtccttgagttgaatgcttagtttatttatttctattctgtccttgctagataaaagcatttaagctataaagtttcaactaagtagagctgaaagtatctcatttattgattcagcaaatattaattgggcatctcttctgaggccaagcattattctaggtggggatttggcagtgaacaaaataaaacaacaaaagcccttccttcatggagcttgtttac

SEQ ID NO: 388037 - DNA, 344 bp, Homo sapiens
agttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccagg

SEQ ID NO: 388038 - DNA, 421 bp, Homo sapiens
ccggagctctcatgtgaattcgttcaaccaccgtgtggtacgaagagcccatcgtagttctcccaaggtgatgctgcctacgggatacaggtgaatcttctagattagacttgtgagtatgtgaggcttggaagtggctgtcgtcatacctggctaatttttgcacttttagtagagacggggttttgccatgttacccaggccggtctcgaactcctgacctcaagtgatccacccgcctcggcctcgcaaagtgttgggattacagccactgtgcccggcatccattttagctttaaaagagacttttgcagttacgactattgacaataattatcgctgatgatgaactcttggatattagtaacccagacaatgagtcagggttttgctgcccataaacaacacattgttacaaagc

SEQ ID NO: 388039 - DNA, 295 bp, Homo sapiens
tagacggagtctcgctttgttgccaggatggagtgcagtggcatgatcttggctcactgcaacctccgcctcccggttcaagcgattctcctgcctcagcctccagagtacctgggactacaggcacgcaccaccatgcccagctaatttctgtatttttagtagagacagagtttcaccatgttggccaggatggtttcaatcccttgacctcatgatccgcctgccttggcctcccaaagtgctttttgtcgaatttttttttaacaataaacatgaatttataattttaaaa

SEQ ID NO: 388040 - DNA, 423 bp, Homo sapiens
cccgagactgagcaattcacaaaacaaagaggtttaatgggacttacagttccacatggctggagaagcctcgcaatcatgatggaaggcaaggaggagcaagtcacatcttacatggatggtggcaggcaaaaaaaatgagagaacttgtgcaggggaaccccactttttgaagccatcagctctcgtgagacttattcactatcatgagaacagcatgggaaacacttgccccatgattcagttacctcctaccaggtccccccacaacatgtgggaattcaagatgagatttgggtggggacccagccaaaccatatcaccttgttctttgcctttagactttataaaatatttatccagcctcctattctttccttgaatttttcccacttacataatggtgtgttttgagattgaata

SEQ ID NO: 388041 - DNA, 153 bp, Homo sapiens
atctacccacctcggcctcctaaagtgctaggattacaggcatgagccacagtgcctggcctgtatgctctatttctatccatagtgtttagcatgtaaaaagcattcaataaattgctgtcaaaggaacatttttttcaaaaaagttctatt

SEQ ID NO: 388042 - DNA, 226 bp, Homo sapiens
cccgtttcctgtgaaggcctcaaatttgtccaaatacccacttgtaaatactacaaaaagagtgtttccaatctgctctatcaaaagaaaggtttaactctgtgagttgactgcacacatctcaaagaagtttctgagaatgcttctgtctagttttcatatgaagacatttcctttttcactgtaggtctcatagcacaacaaatgtccacttgcagattctaca

SEQ ID NO: 388043 - DNA, 690 bp, Homo sapiens
ttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagca

SEQ ID NO: 388044 - DNA, 180 bp, Homo sapiens
tgttagatgcatttcatcattgcgtatcatagagtatgctaacacaaacctagatggtagagcctaccacacgccaaggctgtgtggtatggcctatcgctcctaggctacagtacagtaacgtgttatacaggtttgtatagcacattactctactgaatattataggcagttgttaca

SEQ ID NO: 388045 - DNA, 814 bp, Homo sapiens
cgagctcaattcgtccgagagcgggagcggggggcccttgttgtataactgtagagaagaacagtcaggcttttggcgtctaagtttcagcctcctgccggcaccagatgctgaccaggccctcccaggtggtgagcaatgctgtttccaggagaggcatcctagggccagagaggccaaggtgccagggacatggccccaactgtcccctaaccaggggtagaggagtctagacccttgacatcaacacctatgaaagctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgaggcaacctcctggaggcgggcctggagctggagcggacgaggacacttcgactccaccgagtcgggtttgtgacaatccatggccccttggaacgtgctgtgcagaggaggccgagtttctcgaactgagagatgccgacgaacgaatgatgtcccactctcactgcagacccgtggccgtctgaaacaaaaccaacctgtgctccagaaactcaagatccaatccagccacaacgtgctgagcccaggccccacccatgaaagatcc

SEQ ID NO: 388046 - DNA, 503 bp, Homo sapiens
gacttctagagacttctggagtctctatccccctagagacttcccctagaatttccttatctgactaaggaaacttctttccaaaagaaatgcaattgtcttaagatccccttcctaggaatctcatcaaataatcagaaaagattaaccaccagagaagaatggagactaaagtcagatgactcttcatctagtcctctgaggcagtgccaagagataacctgggaggctttatctaccaggttaagtttcacccctcaccttccggtaacttgctggcgtcgtttagtttcctaggagaatcatttacaagataatgtctgagcctcctgggcccattcatttcccctaaaaatcattaacaacccctgcattttccccatctccctcttccctatgaagcagatatataagcctcaatcatctggccctttgggtctcatatttaatattgtacccatgtttttgtatgttaataaatttatatgcctttttctcctatt

SEQ ID NO: 388047 - DNA, 497 bp, Homo sapiens
taactaaaaaaaattcctttctcatctgtactttaggagattgcagaatcttgtggcgagggtattaaaactgaccattcaaagtcatagcccatttcttggtacttgcatttctctctgtgtaaaattggtacttcatagccttctgatcctgtatttctgatacttattgatcaattatgattgaaagccaggttgtttaacgctctgtcagtcttcaaatgaacttttatttattaaactgtttattccttctgatttaaataaatttcatttcccaaagatgagtaggtatgaaaaataatactcagaagagattgttcttgtggggagaactgcttctacaggatctagctttgattttgtatctttcaatctttttaaaatcaactttaacgaatttaaacctattttaagtgtacaagtaataagtttgacaattgtatgtgacttctaccacaataaaatatagaacatttttatcattctataagttc

SEQ ID NO: 388048 - DNA, 377 bp, Homo sapiens
ccagatgtcataagataatggaactatgcatttagaagttacaggaagaataattctgcatctcaaattccctttccagctgttctggcaattaagtatgagacatttttaaatgccacaaagtctcagagaatttacatcccagaaccatttttaaggaagttacataaagatgtacttcaataagcctagggtgaaacaccccaaatgtagaatgacatgggaagcaagaaactatggaattaagccagaaatccaatgaacaaagatcccaagatacagctatccaacactcctctaaattagaataggaaacattatttaggtgatggccacgctaaaagcccagactttaccactatgcagtatatccatgt

SEQ ID NO: 388049 - DNA, 424 bp, Homo sapiens
gaactataatttgtgaaatgccaatacctttctatttggataaagttaaaaaaaacaggttaacattctctcaggtctttagatagtgcaaaacagtgacaggtatgggtgaggggatgttggggggagatgggatggaagactctataaagacatagtcccaaacagaccttttctaactatttgggcaaaacatgttctcagattttaaaatactattatgtcaattatcttcatttcatatattatgtataattcagtagatggcaaataacaaacattttcttcagaatacagctagaatagccaaggcttaatcaagcattacacttgtctagttggccagtcacaaatgccacatacagataatgtcttacactacctaatcaactgaagaagaaagcaactactttctaaaactgca

SEQ ID NO: 388050 - DNA, 341 bp, Homo sapiens
cacccacagaaacctatctcattactttgtagtcactattcgtgtatttgaaatgattaggaagtttagaaaaccatactctggctgtaagaatcttagtttgccatatcaatgattccgatgctattcctctccatctactactctgtgtagcacaggaaaacacagctcctgcaacagatgttttgagaatccaaatgcaaggaaaatagaaggggaaagcagtgtttatactttataagattcttatagacctacctttttcttttcaacacatgctacgaagtttattatgcttgatctcctgagatcagtgcatgctaggccctatgcttcgtaat

SEQ ID NO: 388051 - DNA, 549 bp, Homo sapiens
ccgagtagctggggctacaggagcgtgccaccacgcccggctaatttctgtatttttgtagagatggggtttcaccatgttagccaggatggtcttgatctgctgacctcatgatccgcctgccttggcctcccaagtgctggattacaggcatgagccaccgcgcctggccagctgtttttaactatacaattcattggcatacatcacaatgttggccaaacatcactactgttcatctctagaacttttttcatttccctcaactgaaacttgatacccattaaacaataactccttattcccctctaccccagcccttggtaaccgccaatctactttctattttatggattgcctattctagatgtttcatatgaatagaatcatgcagtatttgtccttttgtgcctggaggcctgaaaacactcacttaacttagtgttttcagggttcatctaggtcatagtgtatcagaacttcacggatttatagctgaataatattccattgtatgcgtataccacattttatccatccttattggca

SEQ ID NO: 388052 - DNA, 450 bp, Homo sapiens
gggggagcaagctcacctaagacaggagcaacaggaccaccgttctggccttgggcccagagaccaagttgtatttcatgctgtctaggaaatttcaatgtttttcaatgtatttcaacgtaattcaatatattttaatgtatttcaatgttgtccaggaaataagttatctgtctttaaaatcatcccctttttcctccttttctccttttccaaatgttaagcatttcccatcccactgtctaacagcagctgagcagtaacggtttgctcacctgctttaattccctgcagatgagcggaatcttcctcgcagctcagatgtgtaaggaggcaccctgggatgacagtggccccccagttctactgtctgaccttgaatccttcagggcagatgggagaacttgtgaattatgtgtctgtttggtgcctgacacggagccaggaatg

SEQ ID NO: 388053 - DNA, 323 bp, Homo sapiens
gagacatagtcttgctctgttgcccaggctggagtgtagtcatgccatctcggctcactgcaacctgctccgccccatgggttcaagcgattttcctgcctcagccttctgtgtagctgggactacaggcacctgctaccacacccggctaatttttgtatttttagtagagatgttggccaggctggtctcgaactcctgacctgaggtgatctgcctgccttggcctcccaaagtgttgggattacaggcgtgagccaccgtgcctgggccattaccatctcaatgttagatttccgaacaatgttggccagtcttgctag

SEQ ID NO: 388054 - DNA, 228 bp, Homo sapiens
ttgtggactcgaggaattatatctgcaggggcacctgacacaaggtctggcccttcacccacactgcagcagccgcccttgttaacgctgtccccgtccgcccagtccctgcggtgttccagcagcatcttcagtgtgggtattgcaggcaccaatggaacaggttggggaggagagtttgggaccaagaacacccatgaacccttagaagccaccatagaggtaagg

SEQ ID NO: 388055 - DNA, 386 bp, Homo sapiens
cttgataacatggccctctaaactagaagtcttgggatgaatggtaaaattctaagacaataatatagattactttgccacctagaaactagctatgcttaagggaagtgttggcatgggaggaaccctatcaataattcaagtgattttagattactatccacataactataaaaacaaaacattttaaaacaaaaaattttagcttagttgaaaaaaaagagaacttcggctgggcacggtggctcacacctgtaatcccagcactttgggaggccgaggcgggtgaatcatgaggtcaggagtttgaaaccagcctggccaacatggtgaaacactgtctctaccaaaaatacaaaacagccaggcatggtggtgtgcgcctg

SEQ ID NO: 388056 - DNA, 1081 bp, Homo sapiens
aattgacagtgacattatatctgcaaaataggcttcatacctactgtgttagttttagtttcctaggcctgctgtaacaaagcaccacaaattgggtagcttagaataacagaaattgtttgatagttataaataaaggtcagatgtctaaaaccaaagtgttggcagggccgtccctctgaaggcactgaaaaaaaaatttccagtccttctaatttcttgtggttccttaacttgtggcagcataactccagtcttcacatgaagttcttcctgtgtgtgtatctgagtcctaatataaggagactagtcatattggattggggtccatcctgctctgttaatgacctcatcttagctgctgacatctgtaatgactctattaccaaataaggtcacagtatgaggtagtaggggctaggacttttaacatacgaatattgggaggacacagttcaacccattaacacctacttataccttgattaattatatgaaaaccattcagtgtacaactgcttcaaggattgaaaccttgtatgtagtcccagctactctggaaactgaggtagtaggattgcttgaggcctgaagttcaaggctgcagtatgctgattgtgcctgtgaatagccactgcaccccagcttgggcagcatcagaattatagagacagaaagtagaatgatggttgccaggggttgcaggaagggcagcgagagggaattactgtgtaatgtgtacaaggtttcagtttgggaagaagaaatgagtcctggagatggattacggtgatggttgcacagcagtatgaatgtacttaatactactgaattgtatactcgaaagggttaatatggtgaattttatgtgtattttatcacaataaaaacattgaaaaataaaacaatctttgtatgtatatgtatatatgtgtgtgtatatatgatatatatgattgatatatatatatcagtagtaagaaagggaataaaaactgatgaggcaaaatgccctttagagtgaagaaggccttaccacttggatttacaactttaagtccaagtagacaataatagaaac

SEQ ID NO: 388057 - DNA, 450 bp, Homo sapiens
  misc_feature (18)..(18): n is a, c, g, or t
  misc_feature (43)..(43): n is a, c, g, or t
  misc_feature (63)..(63): n is a, c, g, or t
gaatttaaataggactcnactaaggggaaatttggccctcgangcccaaaaaatgggcacgancggcacgagttttgagacagggtcttactcaggctggagtgcagtggcaggatctcagctcactgcagctcgacctcacaggctcaagcaatcctcccacctcagcctcctgggtagctgcaactacgggcatgcaccaccacgattggctgatttttgtatgtttttgtagagacggggtttcaccatgttgcccaggctggtctcgaactcctgggcttaagtgatccgtccaccttcacctcccaaaaaggactgggattacaggcataaaccaccatgcccagccttgattctattttttaagatgtaatacatttatttgtttgattttcaaacagtacataagtctttcccccaatgctttctccaagccacctagttctt

SEQ ID NO: 388058 - DNA, 414 bp, Homo sapiens
aaccatatggcttctgatggttcttgagtaggagaaaccctacttcattaactataacccagatccattgataactataaaaggataaaccagaaagaagctagtatatttctttttggtttcccttcttatggttatcaatggtgtagctatcatatctcatctactcatatttgacaagtggtgtaaattatgcatttctttgttaatgagtctaataggctaattgctctacattctctctctctctctctctttagcgggtaggaaaggagattcacaaatcatgctactactaccatttccaagacttcttcaatccgcttatatttaaatgcaggaaacactattaaaatcatttatgaactcaatactcaacaaagtaaatactagcctaaaatgctcagaatattt

SEQ ID NO: 388059 - DNA, 412 bp, Homo sapiens
attcaaggagtatacaacttttacattcctatagcacgttagggtttattcaaagtgaggtccttcatttgaccctcagaacagtcatgtgaaataggcagcacaggcatcattacaaatgtgactttacaaatgtgagaaggctgaggctcagagaagtgaaatgatttggctaaggtcaaaagcaagtcacagtgaatgcctggtctggagtccggtgtgttttcatctcagcatgcaaatttaaacccaaagaaagttaggtgcttaaatgctctagggtagctgggctttacgtggctacttaccatagtgtttatttgaatgttagagaaatagcttcaagcaacagaaggcttgacttagagtggtttaaacaaatagggatttaatgtttttgtataattagaag

SEQ ID NO: 388060 - DNA, 2295 bp, Homo sapiens
gccaccccacccagcccagacacaattatagttagcattttggtatacagcatttacttccatttttaaattattttgctttattaattagttggtaattatagaatatatgaatatattcaaatttatattttgccttttggtatgaatatttcatcaggatttattttgtgttgctaccacatttttgtgttattttttgtttttttagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccttattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggatatgtcaattaaaatgcccatttgtgaagcttactcaataaaactttaaattgtcaaaaaaag

SEQ ID NO: 388061 - DNA, 2075 bp, Homo sapiens
caggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagaggtaagtaaaactttgtgcagatgccacaggcctccaggatggaaagggtaaggtgg

SEQ ID NO: 388062 - DNA, 4236 bp, Homo sapiens
caggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccttattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggatatgtcaattaaaatgcccatttgtgaagcttactcaataaaactttaaattgtcaaaaaaag

SEQ ID NO: 388063 - DNA, 485 bp, Homo sapiens
tgttctcacgagggggcagcttgggcttgaccgagcaggagcttcatggtcccacacgtagtatgacatgtgacctctgcacattgtttacagttcctaaactgtgatttctttttctgtgaaatagttataatagtaagtggctaccaagtagaaagtggtcatggggggtgaaggttaaacacaataacggacacacagaacttacacagggcattttatgccaagctatattgaatatctatatccctctacctgcccgtcaatgtcatgaatattgacaattcactctagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggtaaa

SEQ ID NO: 388064 - DNA, 569 bp, Homo sapiens
tttaataaatcagactcccccttttatacacacagagcactctctactgtttcttcctagtacttgtcacaatttgtaagtcctaaatcatgtgattgcctacttaatgtctcccgcaacctgcccctggtgttctgtaaacttcaagacgatatgttttgctcacctttgaatttttagatcccatacaacacctatcatatcataaatgtttaataaatatttattaaaagaattaataaatgaatgtggccaaacctattcaggtctgcatggttcctccctagagttccatcacacttcacagatctaaagtttcctcccagttgtggaggtttgaagctcaaaactgctggaggtgcttcccaccatagctcgtgaaggccctattggtgttttcttcctagtccgtctctagttgatcatgacagatgggccagtgtgttttgaagaagactggctgatgcctcaccaaattctggggacaggtgcctttctccaggggaattcatgaagagactctccaggggcagggcagaccactgggaaaaacaagacccttgggtttt

SEQ ID NO: 388065 - DNA, 361 bp, Homo sapiens
gaggtattgttgttactgggaggttgaagggaacacaaattcagttataagtcctttttgaatactaagaggggaataattagggaagctaagaggggaataattaggagaagaaaaaaaaacttcaaacaattttccctgtaacatgattttacttgcatttataaactgatttttttttctaagcactcctttgataatgattaagtgtggggttacattattttagggtcgtctaatatttaagatgacttaaaaacctcacacacgttaatcccgaactgtgaaaatttctcatcttatcatccctctgttactatcaattttcctcacgtacagattcttttataattacttcatt

SEQ ID NO: 388066 - DNA, 343 bp, Homo sapiens
ttattgatatatgaattaaatgcattctgctaataagaaacatatttcgaaataagtgttacaaagtaattataatagatttaattcagatgtagcctaaactgtttattatgctactcaatttatgtattaagccctgtacctgtcctgtcccatgctagctgtagtaggggatggacgcatacacaaagataggacagaatccttaacctgagacgtttccatttagctggggaagacaaggaataggtatgaaatggtaacaaaaaaagattacatggcaaaatatgctccacagataataaaatcagtgaacatcagaaagaaaataggttagtgggta

SEQ ID NO: 388067 - DNA, 713 bp, Homo sapiens
ccaggaaactactcgctgtggctgttgataagcggttgagacacaggactgcaggatgaatgcgctgggagtgggatgagagggcaggcagagaggaacctacaggggctaagcccagctcagtatggccacagctaggagaggaaggctgactctcaatccctaaggataagataccacaaagtgagcagcaatcaaactggagctacaaactgaaggctcagacctgggatgcctcccttggggagagatttttttttccctggcccattctttttctcttctgagtcagcaaagaactccttcttcctcttctacggcatggatttgactctgggaggcggctgcccagccgaggaccacgttacccagagccccttgcatccagatacggccactgagttgttcttgctgatggactgtaagtggaaggcacctgtgtctcttctggcccgaggtgattaagaagcaggtttgctttctccgtcttctctcttctcctttctgctggcttgaagtcaacatccagggtgatctgggaagtcacatttggaaaacagcagagcctctattagcctgggtccctgagtgcctgtgcggagcagagatcccccaccccaccctgacacacatgcatacttaccattcagacctgaccaaccttaaagtgtcaatacgagcaagaaataaacatatactgtggctgagccatt

SEQ ID NO: 388068 - DNA, 275 bp, Homo sapiens
attttataattaccctcatgtataccagtttgagtgtcagttttccctgaagatctgagtttccatctgataacattttccttcagcctgaagaactaactttagtttggagtgcaggttgattggggatcaattctagctttctgttgtatgaaatgtctattctaccttcattgttgaaggacagttttgcaggatacagaattatagattgacaggtttttttcttctattaaagacttcactgtctgctggcctccattgtttctgttgag

SEQ ID NO: 388069 - DNA, 837 bp, Homo sapiens
ggcatgagccaccacgcccagcctaatctattaatgttatttcaggataatagaaggaacaatacagaaggttataaaggaaaactggatcagagggggtcacgaaacagtcacagaatttacctacatttacaaaaagctgtagtttgccctcagagggctgaatgaagacgcttgctgaattccaaactaaatttacctttggtttatttcttttaaacactcatcatctaagcatttctgttactccaattcaggggacacaattcccagattcagagctttctgatataacatcagagtaagcaggcccatctgtcagaaaaggagtgatctgctgaatccgcagctgatttctatgcacgttaaagcagcacagaactaggagacactgactttctgtctcctgcccccacagtgctcagtcatcgtaacaggcctaagacatccaccaagcatttcaaatgtcgtcactggtctgtctcctccaacagaatgaccagaccccactacatacggcacagagtggatggttaagaatgcctcccaacagtggactttccagctgagtgccatgaactggccctactgggagccctggcagcacaaggtccagtatccatactgagcagagaggcacggcagcacctgccctcttttgtctccagaacttcttttccccagcgtgggatcttgagccttccagaaatactgtgctgaggattcagctgggcgggggccagggttgggggtggtcacagcttttatttccatacatatacaaataatggagtgttggagcacctagaaatggagcttaagcctgaaaaccttttg

SEQ ID NO: 388070 - DNA, 303 bp, Homo sapiens
ctggccctgagtcagttaaggaagatcttttcttctcttttgtacaatcctatgatgagagctgcaaagtgaactgactaagagcttctgccttgatcattgacctcccaatcctaataatatgttcactggccaaacttcctaatcgatttgtcttttggatataacgttcctcctactgtttgcctgattgagaaatctgctacagaacatgaccggttagcattcccaccaaccccagtgctacactgactgtctttcgatggactttgctccttgctgcctctctgaggtcccagacct

SEQ ID NO: 388071 - DNA, 198 bp, Homo sapiens
aattattttctaaaagagctaattgctgacatatttgaataaactataaaacttagaaagaatgtatgttattttaccaatccttcttagtgtgaaggaatactacatttattcagtaaaaaaaagtgcattcctccatttaaaatgtaaataactattttatgttcccatccatgactactttacaaaattatatgc

SEQ ID NO: 388072 - DNA, 760 bp, Homo sapiens
gaaggcatttgtcccagtggaagaacacagttcactaccaggtaccaggtggttattaagaaagttatacaactttatctcttcagattgaagagctccttcagataaaagccttaagttcagtcaaggtggaaggaacactaaggtctgtcacttctaaatgacagacaatttaaataacttgtgaaatcattagcctcaaagccatctacctagtaatttttcataatcacatccaatgtgtattcttaggaacacacaagcagactccagtttatctttctatctacttcaatatttgatcacaacattttgagaaatatgctcatgactaattttaaaacctctaatttttctttaatggttttatatttcccaaatacacttaaaggggtggggaggagagaaaagtctattaaatacactgaaactttttaatattggttactggattccctaaggagttagtgtaaattcagttcagttgaatgaaacagatatttcttcatctcctactatcagtatggtattgtgctgggattacggggagaaataggaatgaataaagcaccttctctacgcttaaggattctagaatctataaaaaaagtaaggtgcataaccataataaaagctagaatatgatgaataagaacagaaagtcacaaaattctgtcagaatatatcaatgagattttgtctggctgtatcaaggatgacatcatagaggagagagcacttaaacactgccttgaaagat

SEQ ID NO: 388073 - DNA, 128 bp, Homo sapiens
aagaagaaaaggagagtacataagcatattcatctatgaaaaagaaaagcaagcagaaaagatgaaagagaaggaaagtcctaacagtgcaccctcctggagctcctccaggagctgcttccttgatg

SEQ ID NO: 388074 - DNA, 262 bp, Homo sapiens
tttttttgtagagatgaggctctcactatcttgcccaggctggtcttaaactcctggcctcaagcaatcttcccaccatggcctccaaaagtgttggaattataggcatgagccactctgcccagccatagtactattattgtatcactatatcaataaatcagatttgatctctgcatgtaactcatcacatctaaaactgggcatagggaggccgtaaataaatggttaaggtaactaatggcttcaggtaatctgatta

SEQ ID NO: 388075 - DNA, 476 bp, Homo sapiens
ctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggt

SEQ ID NO: 388076 - DNA, 403 bp, Homo sapiens
ctatgtagagttgtcaattatagttctgtatttgtcaggacagaccactaaacaaagaacctctggatattagatagttcaagcaaaagtttaattttcactcacactgtatgcctgtgtgctttgtctcagagctcttcatgttactatcactctgaaatccaaactaagacttcagcctcttttgggagcattgccaatgaaaaggcagaggaacaaagtgtggtaaatcattcactttctcttaaagccttcacatagaagagacacacatgtcctggtagaaagctagacatatagatcaatgatacagaattgaaagcccagaattacacctttttatttatgggcaactgaattttgaaaaggttccaagactgttcaatgagggaaagaatagtct

SEQ ID NO: 388077 - DNA, 501 bp, Homo sapiens
cctcctcatcagccctgtgtattttgggtattaagacatatttctgggtcaaaccaaatgggtgaaaggctcttgcctgggccctgcccacaagaggccttgtgacacatctctgcatccactgctttggaggtgtgactctcctcttccatctgcaccatgaccacacagaaaattgtgacatacctctgggttcagcaaccaggtgtgtacccaggtcttacctgcagagaaaactgtgacatataacttggcccagtatccaagtaatgtgactttgttgtctgtgccttgctttcaggagagaattgtaacataaccctggtcaggcaaccaggtgatatgactctctgtctgatccctaccctggaaaaattgtgacatatttctgacccagcacccaggtgatgttactctcctgttttctttctactcacagtttgggttgtgacatataccttagccaagctcacagttgtggtgatgacactaataccacaa

SEQ ID NO: 388078 - DNA, 431 bp, Homo sapiens
ctgcacatgctacctacatcagcccagccatgacagagccacaccaggaccgtgggctctattcgaaggagggatgggtgagagggggcatcccacccaagacctctgattccgggccaatctagcttaatgccggcattgggagttttgccccagtcggcacctgctggatgtgtggaccctggattgaaaggaggcgcttcggctgctggatgtgtggaccctggattgaaaggaggcgcttcggctgctagatgcctggaccctggattgaaaggagggcgcttcggctgctggatgtgtggaccctggattgaaaggaggcgcttcggctgctggatgcctggaccctagagtgaaaggaggcgcttcggctgctggatgtgtggaccctggattgaaaggaggcgcttcggctgctggatgtgtgg

SEQ ID NO: 388079 - DNA, 410 bp, Homo sapiens
gccctggagagagaagtcaggcaagtctgagaagcatctccttcatccttgtagaagaaatcaaatcacatacacacacacacacacacacagagtttccttttctggagtcacttgatcctgccacctggagttgtttggaaccccgtctaggcctttcagcaccctttgggtggtggaggctggcctcctcctagcttgtcaatcacatcttcagtggaatgcacacagcgccctgaggatattgggcttagaatcccagccactcgatgtagaagcaacaacatcttactcattttccttcctgcagggcagagggctgaccatggaagggccacattctgaagaaagcaatgtttgaaaacaacaattgtagaacccttttagattaggaatttctttcttctgat

SEQ ID NO: 388080 - DNA, 230 bp, Homo sapiens
ctcaagcccatgtcgaaaatcctattatctatagcactttacaaacagattgtctgaagtggctttttaatacttgaattttctctcctttttaaaaaagttttattttggccaggtgtggtggctcatgcctgtaatcccaacactttgggaggccaaggcaggtgagaggtcaggagtttgagactagcctggccaacatggtgaaaccccttctgtactaaaaatac

SEQ ID NO: 388081 - DNA, 415 bp, Homo sapiens
ccctccctcccttcctctttctttctttcctttcttttctttcctttctcttgcacatctgcatgagtgctcacccttttctcatatttttcagataatcatgtaagttcctgaacagttctagcttgctaacagttgtggcctctgagtacatacataggatttcacaaatcttcctaggtgagcaggggctctggagttgccaggtggggagatgaaatggtaacctatgacatgtatctaaatgccccagtccctggtgaacaattgtaggattcacccgtctttcttctttgttccttggtgccctttctccttggaaattggaagcatgggcaagttgttctagtcccaactctgccttcaggcttggtgttctcaggcaagtctgaatgtggctgggcctcagttgcct

SEQ ID NO: 388082 - DNA, 416 bp, Homo sapiens
ggtaggggggaggactgttctagattttaaaagctatagaagacacagcaaccaaatacactgcatggaccaggcatggatcctaattggaacaaaccaactgtaaaaggatgtatttgaaatgattggaggaatttgaacagtgactgcacagtagatgatatgaagaaattattgttattttttaggtgtgatcatgattttatggtgatgtttaagtaaaagaggccttatttgttagagatacatgtacgggtatagagaaatatttacggatgaaatgatacgatgtctgagatttgctttgaaaactctagcaggtgtgggagaagcaggtgcatgggtgggggaagggatagatgaaataagtatgcaaaatgttagtctacttttgtccctcctgacccagcaggtta

SEQ ID NO: 388083 - DNA, 965 bp, Homo sapiens
cccacactttctacgcccttcgcgcccatcgatacaaacaaacaaaaaagcctggcaccctgtctcagcactcttccaactttgtccccaggcagtgagtgcttcatggccagagagagataggactgaaccctcgtaccttcaaacatatctaaatctctggtgcagttcagagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgagtgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatc

SEQ ID NO: 388084 - DNA, 963 bp, Homo sapiens
  misc_feature (19)..(21): n is a, c, g, or t
  misc_feature (25)..(25): n is a, c, g, or t
aacactggagcggagatgnnngttnatttagggaaggaaggaaaagggctaggcaccctgtctcagcactcttccaactttgtccccaggcagtgagtgcttcatggccagagagagataggactgaaccctcgtaccttcaaacatatctaaatctctggtgcagttcagagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgagtgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatc

SEQ ID NO: 388085 - DNA, 495 bp, Homo sapiens
cacccgaccccttgcgcgttccggctccgcgcgcctgccaggccggggccggcggcggaacagcttgggacccgaaacgcctcggcttttctgcggacccgcgcccggccgctgctgccggacgcttgaaaagaggcagagtcttgctttgttgtccaggctggtcttgaacttctgagctcaagtgatcctcccgccttggcctcccaaagtgctgagactacaggcatgagccaccacacctgtccctctcccactcgtattactcagacttaaactaccccaaaaaggctaaagtcctgctaagagtctccgtagaactgatgattcaagaggctcttatgatcacagctggtgattccctgtgttgaattagtgaaaacaggccaggcacagtaatcccagcactttgagaggactgcttaatgtcaggagctcaagcccagcttgggcaacacagatgcctgtctctacataaaacaataaaaattttta

SEQ ID NO: 388086 - DNA, 1343 bp, Homo sapiens
cacccgaccccttgcgcgttccggctccgcgcgcctgccaggccggggccggcggcggaacagcttgggacccgaaacgcctcggcttttctgcggacccgcgcccggccgctgctgccggacgcttgaaaagaggcagagtcttgctttgttgtccaggctggtcttgaacttctgagctcaagtgatcctcccgccttggcctcccaaagtgctgagactacagagagagaatgctaacgagctgtgaaatgaccaaagatctggcagcagaagggaaaagaaaaaataatgggaagaagaggatttatctgactcaactggagatggctcccttcccttatttattgttgcatcctgaagcttcccccatgctgggctcagtgtgaacaaacagcgcgggagaatgcaaccactgcagaggcatatgtttgagatacctggccactggaggtcatctcgtctactatattcaccgcagataaagaatgaaaagagaatacacaaccttgtgattgctagcagtgaaagctcagagttatgacataacaagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgagtgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatc

SEQ ID NO: 388087 - DNA, 1167 bp, Homo sapiens
atggtatttatagataggccatattaaaaaacaacacaccccttaggagaaaacgaagaagaggatttatctgactcaactggagatggctcccttcccttatttattgttgcatcctgaagcttcccccatgctgggctcagtgtgaacaaacagcgcgggagaatgcaaccactgcagaggcatatgtttgagatacctggccactggaggtcatctcgtctactatattcaccgcagataaagaatgaaaagagaatacacaaccttgtgattgctagcagtgaaagctcagagttatgacataacagaattggctcatgtgactatggaggctgagatgtcccaagagctggatacccaggagaagcaaagagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgagtgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatc

SEQ ID NO: 388088 - DNA, 1221 bp, Homo sapiens
atggtatttatagataggccatattaaaaaacaacacaccccttaggagaaaacgaagaagaggatttatctgactcaactggagatggctcccttcccttatttattgttgcatcctgaagcttcccccatgctgggctcagtgtgaacaaacagcgcgggagaatgcaaccactgcagaggcatatgtttgagatacctggccactggaggtcatctcgtctactatattcaccgcagataaagaatgaaaagagaatacacaaccttgtgattgctagcagtgaaagctcagagttatgacataacagcaccctgtctcagcactcttccaactttgtccccaggcagtgagtgcttcatggccagagagagataggactgaaccctcgtaccttcaaacatatctaaatctctggtgcagttcagagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgagtgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatc

SEQ ID NO: 388089 - DNA, 1015 bp, Homo sapiens
cacccgaccccttgcgcgttccggctccgcgcgcctgccaggccggggccggcggcggaacagcttgggacccgaaacgcctcggcttttctgcggacccgcgcccggccgctgctgccggacgcttgaaaagaggcagagtcttgctttgttgtccaggctggtcttgaacttctgagctcaagtgatcctcccgccttggcctcccaaagtgctgagactacagagagagaatgctaacgagctgtgaaatgaccaaagatctggcagcagaagggaaaagaaaaaataatggaatattttctgtctacaattggttgaatctgtggatgtggaaactgcagatacagatggagagccgactatactagctttttgtttcatttttcacttctggtgtgtgtgtgtgtgtgtgtgtgtgtgtgtgtgtgtgtgtgtgtatcgtgtgtgtgtgttttattaatctcgtgtgcgtgtgtgtgagtcttctctcctctttatgtgggattttcactaacattctttatcagcttcttcaggttggatacttgttgccatatatatttttttcatcattctaagaattaatataatagtgggcccgaggcgtggtggtctcatgcctgtaatcccagcactttgggaggccaagatgggtggatcacaaggtcaggtgtttgagaccagcttggccaaagctggtgaaactccatctctactaaaaatacaaaaattagctgggcatggtggtgcgcgctctataatcccagctactcaggaagctgaggcaggagaatcacttgcacccaagaagtggaggttgcagtgagccaagattgcgccattgcaaccccagcctgggcaacacagcgagactccatctgaaaaaaaaaaaaaagaataaatgaatgtattaatcaccaaactgctcttcatcagaaactcttagcagtggtatgttgaggtctccctgcctaccgtatatgtctctgtgcaggaacatcctgtgccgaaa

SEQ ID NO: 388090 - DNA, 656 bp, Homo sapiens
cacccgaccccttgcgcgttccggctccgcgcgcctgccaggccggggccggcggcggaacagcttgggacccgaaacgcctcggcttttctgcggacccgcgcccggccgctgctgccggacgcttgaaaagaggcagagtcttgctttgttgtccaggctggtcttgaacttctgagctcaagtgatcctcccgccttggcctcccaaagtgctgagactacagagagagaatgctaacgagctgtgaaatgaccaaagatctggcagcagaagggaaaagaaaaaataatgggtttgtatattatacattctggataatcagctcttgaatgattaagtgtggaatacgtcttacggggaaaagcagatttttaatactcattttgtcccggcgcggtgggtcacgcctctaatcccagcactttatgggaggccgagacaggcggatcacgaggtcaggagatcgagaccatcctggctaacacggtgaaaccctgtctctactaaaactacaaaaaaattagccgggcttggtggcgggcgcctatagtcccagctactcaggaggctgaggcaggagaatggcgtgaacccaggaagtggagtttgcagtgagccaagatcgcaccactgcaccccagtctgagcgactg

SEQ ID NO: 388091 - DNA, 261 bp, Homo sapiens
gcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacaga

SEQ ID NO: 388092 - DNA, 252 bp, Homo sapiens
tggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagt

SEQ ID NO: 388093 - DNA, 785 bp, Homo sapiens
tcccgggttcaagtgattctcctgcctcagcctcccgagtagctgggactacaggcatgcaccacaactgccagctaatttttgtatttttagtagagacagggcttcaccatgttggccaggctggtctggaactcctgacctcaggtgatccacccaccttagccttccaaagtgttgggattacaggcatgagccactgtgcctggctggaatattttatttttttaatttactagtctcactggataactgagtcttgacttatggaatggcataaactcttgatgcaggcatgaagaataaaattagtttttgtaaactagagaatttgaaactgcttagagaatagaggtaaaaaggaatttccttctttgggtaagagtggatccaaaccatatattctctggctattagcgtctccagaggtgtgtggtcattttttgttatggtgattcccaaagatttgcagtgttggcaagtacccaaaatttatctcagctggtcataaaccttagtgccttttgatggttttgttttatagagttacttattaaagttctatgtaaatcattactgttatccttttaagtttctgtatttaactattaccattttttattttatagtcattacatattggatattatgtagaatgtagttatgtatagagtgttttatctaattatttgttgctgcccttttctgagagttatttaatacagtttgagatggaatttagcatttttgggccttccctcactgtttgtaaataattgattttg

SEQ ID NO: 388094 - DNA, 834 bp, Homo sapiens
gatctttactgggaccaaagtaacctttgattgtctctgactgtggctgtttttccgggagctttatgtgctgggctcaggaaaagttcaacccatcaataggttatcacatatatatactctgggactgattggaccacattttctcactgaattgactgattgatgaattcagttggcagaattaactcttctatgtctacatgaagtgccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgc

SEQ ID NO: 388095 - DNA, 348 bp, Homo sapiens
ttccagtgcacagccacaagcatggcgtcctcttccttgtcctaaaagggcttcccttagatggctttctctcagcacaccatctctgctcttgtcccccgtatcacacacttctcactgggtcctttcaccttcctcttctccagccctggccatcggctgctactgaaggccattctcagtggcccaggagccaaccccctagctgcctcctcagagtttctgggcttcccacccaccctttgcctcccctccatgggttctcctggtgacttcctgccaggcttccattttctctccatccccgtgctttttacctgctcctctgctggccgggcctcctctccc

SEQ ID NO: 388096 - DNA, 445 bp, Homo sapiens
ctgaaatatgttggtagagcgtcttacttattcataattgccctgcttggactgggcaaaaaacttggagagcacagcagtttcgatggtagtaaaatggagacaagttacgaaatccaggtttgagtccagacggaattgctcttgtctccaagcctttgttcatgcttttccttctggctggaccccaacctcattcgcactccatgtcttgcgcttctcccatcccccatgtcccccatcccccatgtcccccatccttcatgtcccccatccccatccacataacacctctttctactccaggttaattctttctaataatgatagtagcggtttattcttttaatttttcgaggaatcccttgctaacccaaaactggaacaggtcgtgtacttttagcatgcgtgtacttattacacaaacaattgtctttttaatagt

SEQ ID NO: 388097 - DNA, 402 bp, Homo sapiens
gtagctgggactacaagttcgtattatgcccagctaatattttaaaattttttgtagagatggggtcttgctgtgttgcccaggctggtctcgaactcctgggatcaggtaatactcctgcctcagcctcccaaagtgctgggattacagatgtgtgccactgcgcctagctaatccatactctagatactatcaaagcacctactgtgtgtcaggctgtgggtgccaggttctgaagtagtgatcacaaaagacctgtcctcatggactgcacattctggggagatcttgctgtcccatccctcccttgcccacatgagaccttgctaaatggccacagcattctttcctgtctaccttaccatcattctcaacacagtactccaggaagcctgcgcagtc

SEQ ID NO: 388098 - DNA, 378 bp, Homo sapiens
ttacgggtagggaaaggagacctggctaggaaaggtggtcttgttagaagctttctgagagaatggatgttaaatgtttaagacctttaaaggtgtcagacaggctctcatttaaccttttctagattccagacaagggaagtcctggctgcattaatggagattctccatagacgcagatttctttcaaaaaagacagctttgcagcaccacttctgtttgctggccctctgatagccatctcaaaatatgtcaaataaatataatttgaggtaaaacatttttatttccttcaaccactacctttccttcttccccagccagtccttaagcagtcatttaaaaaattagaaactttcacctaactgaattcttaat

SEQ ID NO: 388099 - DNA, 760 bp, Homo sapiens
cgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgactacagatgatggtggataaggatggggatgtgactgtaactaatgatggggccaccatcttaagcatgatggatgtggatcatcagattgccaagctgatggtggaactgtccaagtctcaggatgatgaacattggagatggaaccacaggagtggttgtcctggctggtgccttgtgagaaacgaagcggagcaatggctagaccgaggcagtgcacccaatcagaatagcgactggctatgaggcaggctgctcgcgtgactactgaacacctggacaagatcagcgatagacgtcccttgttgacataaaggacacgaaacccctgcagttccgacacagcaaaaaccaagctgggctccaaaagtggacacacagaggatcaccgaccagcatggcatgaagaatggccgggaagtgccgagcagcacatggagacacgagactggaggcgcagagacgaagactgaagagacataaacaaagatagaagggaaagaggggaggcacgccatggagaaactaaacggcataagggcgcgaagagg

SEQ ID NO: 388100 - DNA, 437 bp, Homo sapiens
gaggtgggaaacagcagttgcaggaaccataagtggctccgtggagctgacgtggtggaggacagacatcacctgggcttgggcttgatgggtcaaggggtcttaggtgctaagctcaggagggatggcaacccagaaaccttgaaggtggataaggaaggggagatggggtcttaggaatatgtgtctggtggcgcgtgtggaaaatgacggtgctaaggctgggaggacttagaggccagtggggaggcccaggtgctgatgccactgtggacattcctgagcctctcagctacctgaggccgcacttccacccaaaaagagtccttggctgggccgggtgtggtggctcacacctgtaattccagcactttgggaggccaaggcaggtggattgcttgaggccaggagctcgaaaccagcctggccaacatggt

SEQ ID NO: 388101 - DNA, 332 bp, Homo sapiens
agtttcaaaagggtttgtgtttaaatactggtaagaggtcaacaaggatttcctgatcccacttatgttgaaaaatcagcttgtgttttagaagaggtaagaatctcttctaaatgtgttaatcaatcccctccaatacagtgtgataggaatattcaatcctattctctttatgattttgcacagacttccttttcaaatgtatcagcccagggatttgtatcattacaaatttgtgaatatggatgcagatttgttggaaactatgtggaaaatatgagaagtctaagagatatccaagttatttgctaattataacaaaactgtagcaa

SEQ ID NO: 388102 - DNA, 634 bp, Homo sapiens
taattgtcttatatatctaagtgaaatcgtaacatccatcatttctttactggtttatttcagttggcataatattctcaaagtgtatcttcaaatgtgacgatttttttcaaggctgaataatattccattgtatcaaatatgtcttcaggttcctatgttatgtattttagatatagattcataaatggaatcactttatttaataatttatattatttgaagtacatttataacattataaaataattggtacatctttattttccaccgacaatcaacccaactaacttttgtatttttagtagagacgggatttcaccatgttggtcaggctgggtctcaaactcctgacgtcaggattcacccacctctggccttcccaaagtgctgggattacaggcttgagccaccacgcccggccaagggttttatttttattgcatcatcaacagatttggtgttttcaaaaaattgatagtggccatttaaatgagtgtgaggggattttgttttttattatgacttttatgcatttctctacaaattagttttgagtgtcctttcaaatttttgaagaaaatttatttcaatttgtctatttctaaataaagttattcaatttgattgttca

SEQ ID NO: 388103 - DNA, 311 bp, Homo sapiens
ttgatttctaccattcctactactggtttgcatagaaagagagaagccagaagtctggtaagaattcctaccagtctaccagcatgcctggctgctggcttctgggttccctttccctgagcagccctagcgaccctgcttgccacaccctggggaccaagccacaacaccaaggaaaaatcatcttttttccatttcatggaaactttgaactagacaaaagtcattttctgttagaaagttaaggtttgtactgcatgttgccatgtgtgtcctgagaagggggagtagataaagaagttgtctacata

SEQ ID NO: 388104 - DNA, 375 bp, Homo sapiens
cacccccaactcttcaccaagtaggggccctggcttgcaattgcagaagagctttcccatccctgggtgagcatacctactggtagtggctccgtgattccctggggaggggctcccagaggtaaccaaccaaccctgtgctactgctatggccacagttctgcttctgctgccctcaaactggggaagaaacaaagagcctgagggctttactcacgcttctagcactacacagtcaccatataaagaggagcccagtctctcttccttgtgaacccttgacccccaactcttcaccaagtggggcccccagcttgggccagcagcacagtggccccacccctagctgaacattccagtagcagctgctccgcg

SEQ ID NO: 388105 - DNA, 539 bp, Homo sapiens
ctacccaccggactgatttttttccgcctcaatgaattcactaaattggcatattatgttggtgtcatgtggatataggttagctaacttaggtaaatttcaggcaatactttcctcttccaaaaatgacccacaacagagatgtggtgtgttttaacgctgctcttaattgttcaaacactcgttcatttgacaatcttttaacaatacctgaacacctcagtaaaactaaacagtcacaggggaaaaagctcaacttttaaactaagggagaaagatgtagtatctgtcatagaccagcagtaaatacatgtaacagatgtgaccagacctgatctaacaagttctttagaatgtatcattttagtggcccaactttaaaacgactttttaaaaagatgtcaaagctaggatgtttatcttttcctcacaagagtcaaaagtaaccaaataaactgtccttctgctatatcagaaaattaagtccatactcatcaataaattatagactctttagatgattttctttttttggtaac

SEQ ID NO: 388106 - DNA, 270 bp, Homo sapiens
ggagcagggctgggagtcagtgggagattgggagtccaagtctggacatgttacatatgctatgtctattacagatctgagtataaatgtgaagtggagttttaccacgtgattctgaagttcagagaagaggtacaggttagagataaagatttgggagtcacaaatataaagatgtatgacttgatgagattaccaaggaagtggagattaatagcaaaaagaaaagtttcaagcttcaagccccgaagcattctaatgtttacagct

SEQ ID NO: 388107 - DNA, 383 bp, Homo sapiens
tatttttagtagagacggggtttcaccatgttggccaggctggtctcaaactcctgaccttgtgattcgcccgccttggcctcccgaagtgctgggattacaggagtgagccactgcgcccagccctcatctagtatcttttccaacaattctactccattcatttttcagaatgaagctgcatatatgttagaccatttgatcctatgccatagaactctgatgaaaggtttttttaattaacgattttcttttcctgtgtgctttatttttgataatttttattgtcttctctttgggttgctcatctttttttttttcctgttttgtccaagtaaccattaagcccatccagtgaattaatcattccccagataactgta

SEQ ID NO: 388108 - DNA, 494 bp, Homo sapiens
actgcctagttgcaggaaaacaagctcaggactccaacttattctatgttatgttgattaggtttctcctcgtagtgagagacatgggcaccagtaactaccagagacacaaaacctcacagctgaacctcaggtcttgcctgtagtaccttatgcagctatgtgagacggaatgatcctagatgacctcaattacatgtctggaccttcgctggagtgtctggacattctttgtctgtgcagtgtctctctccatgtgatttatcatcttcaaggaggctaaactgtgcttatttgcagaataagagtgttgggattctaaaagggcatattctattggttaaagaatgccatccaagattcaaaaggaaagggaatagatttattggatagcatggtgactatagttaatgacaacatattgtaattttgaaaaatgttgagtatacctattaagtgttctcaccacaaaatgataatgatgtgaagggatg

SEQ ID NO: 388109 - DNA, 669 bp, Homo sapiens
ccccgcaggctgccctggtgccagggcccccaggcaggagctaattcccgccagccaggaagtatccatcaccctcaactgccctgccccacagcacaaatagcttgggaggaaaggacagccctgattgtggggcaagttatctcattagtcctatgaactatctgcaggctccacactgcaggctgacgacactgtttttataaatctgtattgcatggagcagcaactggtaacctgtattgattgcaatttctctttttgaattgggaggtccctgggggccagttgaggtacttcgaggccctggcatcctgaagctaccccaggaaacagacttgagctgtgacagactaagtagctcttctcttccaagagagacaacgatttttttctgaccctgtggccaaagcctggtctcaatgcaaagcctcaccctattcgcttcctcctccctctgactccatatcccccattgcctactgggaccttccttgcagaggaaatgggggaggcaaagcaggaaaccccttcctcagcttctggttttcctgcttcaggaaggcatctgactccaatagtggaaaagcagctcccaaccccatgtgaatacctatgcactacatacgcatcatagacctgcctcccatttagtattaagatctttaa

SEQ ID NO: 388110 - DNA, 1113 bp, Homo sapiens
  misc_feature (568)..(568): n is a, c, g, or t
  misc_feature (594)..(594): n is a, c, g, or t
  misc_feature (602)..(602): n is a, c, g, or t
aaaaactcctttttgcaatagaagagacagagggatttggacaagaatgaatgtggcttcttattttggaggagctcttgcatttaaataccccagccaagaaagattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatagatgatagtggctctagttttatagagctccaagtgtattaaacatgacagccattcattcataaagatctggatttgctttaccttgttaatattatctaggggaaaaagtgcaaattgctccatgttctactctcccttatgtaacatctcctgagggtgtttagttgcatggctgttcagaaaggtattaagggcttaggccaaatcttactttgagtatgttaaaaaaaaaaaaaangctgctggcttttctgaagacaggtncttgaacntgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcg

SEQ ID NO: 388111 - DNA, 1092 bp, Homo sapiens
  misc_feature (627)..(627): n is a, c, g, or t
  misc_feature (633)..(633): n is a, c, g, or t
gtagaacttaaagtataatttaaaaaaaaaaaagtgcttcctgggaaagcaactgaaacttatttttaaaatttatgtcaggacattattctgtttttcctgtgaatgccttagtttttcttcagccactttgtagcctccctatacctcttaaaattcataaattctatattcaagttgctcttaatttctccctaatactattttctttcttctgttactaataaagtagcggttttcccataatagtagaaccatagggttagtttgcacccaaggaatggcaaacgttcttgatatttgattattagcattttcaaaaacaaccagttgaacacccagcagctatagtttttattggtgcccctaagcttcacgaccaatctgacccagcaggattcaagcataaaattgccttaagtcttcctacaattggaggacaaagaagagggagtaactaccctattgacaagtcacaggtcatttcttgtttactgggtggcatcgctaaggtctttttagttaaagcatctaaagtaatacacattcattactgtgaaactgccgattttttttcctttggtcctgcttcattaaaagtgttgtttttgttgttgttgtttttgngatgangtcttgctctgttgcccaggctggagtgcagtggtgcgatcttggctcactgcaacctccccctcccaggttcaagcaattctcctgtctcagcctcccgagtagctgggattacaggcacgtgccaccatgcctggctaatttttgtatttttagtaaaggcagggtttcaccatgttggccaggctggatcctgacctcaggtgatctgcccacctctgcctcccaaagtgctgggattataggcgtaagccaccgcacccagccaaaaagtgttttaataagtggttttatacttcctggtgttgagtctgtaaattttaaacatttcctcccagtgtggttaatattttcatgtcacgtgactggattcacagcttgtagtttcaaatgtttctgtctttaaaaactctcttatattttacttttaaaactatttttatctaccagtgggtcagt

SEQ ID NO: 388112 - DNA, 323 bp, Homo sapiens
gcagggtgttgggaaccatggcggcaggtgcaggaactcagggctgaccacagcggagctgggtgggttgaacagtgtctccccattcacatatacccaggaacctcagaatgtggtcttatttgggaatagcgtctttgaagatgtaaataagaattgggatgagataattattggattaggatggaccctaaatcaataacagtgtctttgtgagagacaaagaaaggacacagagacatggagaaggtggtcacgtaaagatggaggcagagattggagtgacacatctgcaagcaaagaaatgccaaggattgtcacaa

SEQ ID NO: 388113 - DNA, 339 bp, Homo sapiens
aaaaaaagatcaaaggacaatttatagtaaaacacacccttgctcctgtattttgcttcacactgtgttcccttttctcatgtccttggttttcccaggcgggcttccacagggcttggctcattcactctggctagagaatttcctaacattttgtttattaatactactagtagttccattactatgaatagctgcaatttacagagcctctaactggtatcctccttgagtgcaggtcctgtgtggcccctagaccccagctcaggtccagcccatggatgctttcaatatgtgtttttagcataaatgaagagatctatttagtgccaggcattg

SEQ ID NO: 388114 - DNA, 133 bp, Homo sapiens
ggggcttggttgggtaagagtttccagatctaaatggagacaggactgggatataggagcttgtacggataaacaacacaaacaccttgggtaagtgatacaccaagagagatcaaaatagggtaggaacacg

SEQ ID NO: 388115 - DNA, 250 bp, Homo sapiens
cattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctg

SEQ ID NO: 388116 - DNA, 320 bp, Homo sapiens
  misc_feature (265)..(265): n is a, c, g, or t
ttcatattcagaagctaaaataatctttgaaacaagttctttaaaactgatagctttcaccatggcctatctgtaaaagttataatacaagttctcattccttggtacttatttttaataatgactattaaaagtctacatgattgtgttggtattttcagggtctttttggtgataggactttagggaagactgggttgacccaggtataacttttctaaaaatgttgacattgtaaaaataggaggccgaggcaggtggatcncgaggtcaggagatcaagaccattctggctaacacggtgaaaccccgtctctact

SEQ ID NO: 388117 - DNA, 135 bp, Homo sapiens
ggacctctattcatttgttttatttgcttaattttattacatgaaactttttgtacaacacatttgagaaccctgggtttagaacaacttagaccctaagttttcggtctcagtttccttttcctttgatagatc

SEQ ID NO: 388118 - DNA, 252 bp, Homo sapiens
gatgcagaagatgaggccatgtcctcaaaaaggggagagacagatgcatattgattacagtggagtcagaggagttttagtgcaggcgtgcacagtaaccacaatggggccagcctggtgaggacagtcatggaatccctgtgaatgaactcttagaagggtcatggaggaggtgagctggggtgtagatgaaggaggtgagctggggtgtagatgaaggagtgtgagctggggtgtagatgaaggagtgtg

SEQ ID NO: 388119 - DNA, 410 bp, Homo sapiens
aaaatcactttctgaagaaagaaagagattgggctgagtgtggcatctcagcctataatcccagcactttgggaggctgaggcaggaggatcgcttgaacccaggagtttgagaccagtctgggcaatatagcgagactccctctctacaaagatttttttttttaaattagctgggcatggtggtgcatgcctgtagtcctagctactcgggaaggctcaggggatcccttgagctcaggaggttgaggctgcagtgaactatgattgagccactgcactacagccagggtgaccgcaagaccctgtctccaaaaataaataaataaaaataaaagaaagaaaaagaaaatggctaagaggagaggcaggggaagatgcctcttttggaaatggggtgttgccatactg

SEQ ID NO: 388120 - DNA, 1452 bp, Homo sapiens
ctcctgccaccacccgtggctaatttttttgtatttttagtagagacagggtttcaccatgttagccaggatggtctcgatctcctgacctcgtgatctgcccgccccagcctcccaaagtatcagatgattttaacaactatgcttccatgacttgctgggctagatgatatgactgtaaaatgcctaacccatggtttagcatcaagtaagcaaattgtaaatggtagcactgctctgcctatgactatttagtcttgtgctttaaactcaaatatttgttggcctactgaagtcaccacacagagaaagatgcttttcattctcagtaaagaactttgggagataactggggcaggcagcaagagaacagatgtcatatgtctagcatcagcaaactcatcagaactgatgggcagctcactttgcttagaacctgcaccagcatacacacggggctgcttcccagtcacactgctcctgggaaggtaggggggctgctgttctgcaattagcgcggttctttacctcctattaccgaactgccagagttcatttgtgttcagttaggtagatgaccaattcttgttcattcctattttcttttgctcactaatgtgtttaacgttcactaacctaccaaatgtgatttattagcgactttttctttgaagatggagtggaggaatcctagcgctttctgcaacatgctactgctgttatggaacagtgcagatatggaagtgcatcagccggggatggggagaggctagggcagtacatgtgaatggagaggtagccccaccagtgtgttttctgaaatacagtcccgcagagggcagtcttgggaaattactgttctcacacactcttcttgaccctacccctccagcacctcccttgctatccaagggttgggatttttaaaaagaaaaacaaattttaaaaaaagcagtgtgaatcttttgccatcttgtaagggtgaaaagccccctaccaagtcgggatgaacattcatgcgtgtgcttgagggcttgggaaaaagacagggcttggccccacagtgcaggtaggcccagtgatcctataataggggccaggagatgggaggtcccctgtgggcaggagttcaagtatgtggtattatatgactggtgcttgatgaacccagggagagggcaccaaaaacaatggtatttaattgtaaaatctccaccccctgaggatatgttttcaggtctgggtgactaattagactgggaaacaagggcaggaacgatggccctgtgcttgctctgcccgctgcctctgtggatgtgtgggctgctggcttcagtcctgcttttctttctgatggtattgtttatgctatgtgtttttgcaggaggcctgaggtgggctgggttctcctcctatggcagggcttcactctcctcctccttctctgttggg

SEQ ID NO: 388121 - DNA, 1533 bp, Homo sapiens
ccttgcgacacatacatcacacaaaagatcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggctgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccaga

SEQ ID NO: 388122 - DNA, 792 bp, Homo sapiens
agcagcccgactctatgtaggatcccctgcctgctgtcgctaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccaga

SEQ ID NO: 388123 - DNA, 1870 bp, Homo sapiens
ggcctgcataggacctcatacccttccccaaacttctggctgtcacctgcattgtcactgtgtccaaaagcagcagccgggagcgcaccaggatgtcatgaccaccccggaacacaccagaccaggagcaacgtgtgggtgtgcttgttatccggcacttcgtctgacctctcacaagggtgcattcccaagaacttcacaatattacccaacagcctcttcaagtgtcttgatggtagagcaaggtgaacgtttcctccttgctcagattcatcccctacctcatcccaggctgcttcgaagttgcagtgttcatgacctttgtgaatgtgatcagctacagtgacttccagatcttccagcacatactcatcctcatagccttcgtgcatcagaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggctgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccaga

SEQ ID NO: 388124 - DNA, 463 bp, Homo sapiens
ttgggacaacctactggcatttgaaattgatccaaaaggtgtaacagtttacagccagatgataatctttttatttggtgattaggaatttgagactaggagagagaaagtgacttggtcaagatcacacagctagtaatcgcaggtatgagaatagatttaggtacatgatgctcaactctgtggtaatcttgttgctacacagaccttgtctcattgtcttcattgatattgaagggtttcctagtttctccacttcttgattttcaaagttgtgtttcaacatcatggtcagtaggatgaaagccatcgttctggattcatggaaagcctttggttttgcctgctttagtgacttgttcaggatattcagtccttagtattaagcaactcctctttcagcttcaaagattttggataactccaaaacctttgtagtataaaaccatgcagttcaaaggcc

SEQ ID NO: 388125 - DNA, 323 bp, Homo sapiens
tccaattcctctcctccctttctctttgaactccctccaaaccagcttttaagtcagcattctactccagctgctcttgccagggtcgccagtcggtaaacgcagtcaccagttctcaggcctcctatttgacctcaacacagcatgtgaacacagctgagcactgtctcctcttcggaaccctgtcctaagttgacttgctggacaccacactctcctggttcttctcctacctgaaaggcggctccttcttatcatctttgctggtttctcttggtgtcaatatttaaagtttgcagagggaccccgggttcagtcccttg

SEQ ID NO: 388126 - DNA, 865 bp, Homo sapiens
ttctgagattaaccttttcggtgacgcggggagccatattgaaacctggaaacgatgaggctgcacggctcaccgtcttggataatggcaaagatggcctgcaagtgcgtgactctcgttatggaaatctctgtcctggagaggtgcttacgaaaagcgccatcttactctaggcaggtgcctggagtgtcctacgaggacgaggaccatattgaatcgtgacggattttcttacaggagtcacttcctaactgtagtctcctggcagaaaagaggcaacctccagccggtagtcccagacgaggtacctgcagagaatgatgtatgatctggtcatagacaccgtggatttcaactctccagagtctaaacgctgaaaacacccaacttgatttagtgccttacactctttatctccgatttttcaggacgacacctgttaaaatgttttgccacactttcggcgtgtattccgattatctttttggaaaatttgatcctgttaaatagactatacgtgggatcaacccaattcctgataaaatcggaagcataatgaactatctaatggcctatattagctcccagttctattataatgataaatgctaccgaactctcaccataaatatgctttttctgcgccccaaaggtaaacttaaccacaacaccctgacagtacagatagcaagtggcaaaactgagacagaaactcaagcctgcctcattacaacagcagcagtcttcaccgctgctggagctggcaaggtcaccaagtctgcccagaaagctcagaaggctagatgaatatcatccctaatacctgccaccccactcttaatcagtggtggaagaacggtctcag

SEQ ID NO: 388127 - DNA, 144 bp, Homo sapiens
tggccttccaaagtgctgggagtgcatgagtcaccacgcccagcttccttttctcttttcatgtggatcctgtgtgcaacagtgtgccttagagactgtggtgaaagaacacttgatgtttcaggaaatcgatctcagggcagt

SEQ ID NO: 388128 - DNA, 401 bp, Homo sapiens
ggtcttctgaatgtttggatagccaatggctttgcagcccagcctggccactacatgaggccgatgactttaacaaacttatttcaggccagtgtaaatgcagtgttcaaaaatcccacctaagaaggatgggaacacggaggtttgtgtaggtaacatgcaggtgtgtgcacatgtacccaagaatgcacacacacatacatggacacaactgcaattgatacaaaaggctgaactgtgctgattcttacaggtacttggttctggcccagtctggaaaaaaagaaaagatccttagtctaaacatgcatacaaaatagaattcccaccatgctttgatgttatctatttataattttcaatgtttcaatgttttgtggtcttaaaaattacaaggatta

SEQ ID NO: 388129 - DNA, 547 bp, Homo sapiens
agactcctgggctggaagctctagcaagtgaggctcacctggcgagcagtggtggaggttggtgggatcacctgctctgctgtccaggtgcttcccaggataacaggagtctaagcttgatgggtgatttcagaaaaagtaggatcactgggtccaaagctggagcaagaattgtttgcttggctaccagtggtggtgggtggtgtcacttgccctgatatctgagtgcttccagggacatgcaattgcttttaaaatgagggtaagaacagagaaaatatgctgtaataatatatatatatattttaataattgccttcatacttccctttacttctttggtttttcaaatgtagatttgaaactacagcctgatgtcactagcttttagcctgaagaacttcctttagcatttattttaaggcaggtatgatagcaacatattgttccagctttggcatatctgggattaattttgtttcattttcattttgtaaaagacagtttcatttcttgtttctgttcttcattgtttctaataagaagt

SEQ ID NO: 388130 - DNA, 363 bp, Homo sapiens
gttttaactctcttcgtgagagcagcaatttttagtcacaattaaaggacaactcttggaaatttattttactttatttttatctaacttttatttttaagttgagaggcacatgtgcaggtttgttacataggtaaacttgtgtcatggggctttgttgtacagattgtttcatcatccaagtattaagcctggtacccattagttatttttcgtgatcctctccctcctcccaccttccaccctccgttagaccccagtgtgtgttgttcccgtctgtgtgtccatgtgttcttgtcagttagctcccacttacaagtgaggacatgtggtatttggttttctgttcctgcattcgtttgc

SEQ ID NO: 388131 - DNA, 377 bp, Homo sapiens
caccaaggaagccaaaactcttgacagagcacactgaataggcaccacgcctgtcttacaaatgggaaaatcaaagtccccccacgagttggcgtcagtagcgttcacatcccagactgatcctgacatttatttttacaaaacaaaccatctcaaaacttggtggcatcaatattcattctgtgcacagaactcttgtttggacagggcttcatccggatagctccactgggcattagcgggtgcccccaaggccggtgggagtcacagaaggctcctacgtccaggccacagctctggccggaccccctcacagcatgtgtgtggatcccacgggccagctggaagctgggcacctttcctgaccaggcgtggaa

SEQ ID NO: 388132 - DNA, 286 bp, Homo sapiens
taattatattaactataaatggtctgagcatatcaattaaatgacagattgtgagacaggaccagaaaaactttcccaacttgatgctgtcaataagaaatccatttcaaatatagtgatataggtcagttacaagtaaaataatagaaaaataaatccaaagcaaacagatagaaaagaacagaaaataatgaaaccaaaaacaggaaaattatggagaaaataaacccaaagctagttatttgaaaagatcaataatatcaataaacttctggcaagacttaga

SEQ ID NO: 388133 - DNA, 1021 bp, Homo sapiens
cggagcgattagagcgaagtgcttcggtcaggcagtatctttgaaaataatttggccaatgaaagccctggcattggatgaaagtgctagctgctgggaatgctacccctccttttggttctctttcaagtccttcaggttcaaacaatacagaagtgtataaagtaagaattggaagtctcttcgctgctctaatctcactcctcagaggtgatcactggacctgagtgagcagaaggcttttcagaattacagcctgaactatttcttgagcaatttgggaactcatttctaaagcagtcctcagattcacacaacgtagtttgtgacggagtatgcccagagcagtgtggaagatgatcaaagtatgacatttcttctaccccagaggctggcatttctgcaggcacaaatgagcttggttttcaagcactgctctttgaacacaaggaattcctttaatgatcacgccggactatatagactttggaatcagactctttgaattccagctctgccatttaccaactttgacactttggggttttggaaatctggattgtagcagggcattgtggatctgcctgttggtggagaaccctagactgcatgcagccatgcacatgatctggagacacagcagagacaaggtctttgtctgttgctcaggacggagtgtagtggtgccatagcacactgtaatcttgaatttctggactactggcatacaccaccatgcttaggttcgggccacaacatccgtgactttaccggttttggtctcttccttgtaactttcggctccaggatgctgcgcactcctctctgcactatctatcagaacgttgctctgcgtgcttgaaagtttcgccaaacagaagtacacaaaaacaaacagaggcgaaacacaaatcccctcagccctggaggaaaaggccttgaagctcttccagtgcagaggccacgcagaggacatgctcctacctgtgcacatcggccacgcctggggtgcctcctggag

SEQ ID NO: 388134 - DNA, 1052 bp, Homo sapiens
actccccaatcccttccagcctcagagcccgcctggcaggactactgagcaaggccttggaaaatcggagcgattagagcggttcaaacaatacagaagtgtataaagtaagaattggaagtctcttcgctgctctaatctcactcctcagaggtgatcactggacctgagtgagcagaaggcttttcagaattacagcctgaactatttcttgagcaatttgggaactcatttctaaagcagtcctcagattcacacaacgtagtttgtgacggagtatgcccagagcagtgtggaagatgatcaaagtatgacatttcttctaccccagaggctggcatttctgcaggcacaaatgagcttggttttcaagcactgctctttgaacacaaggaattcctttaatgatcacgccggactatatagactttggaatcagactctttgaattccagctctgccatttaccaactttgacactttggacaacgtctcattctgtcacccaggctggagtgcagtggcacaattatagctcactgcagcctcaaacacctgggctcaagcaatccttccacctctgcctcctgagtaattgggactacaggcatgtgccaccacacccagctaatttttaatttttaatttttttgtagagatggcggtcttgctatgtcacccaggctggtcttgaacacctggcctcaagtgatcctccggccttggtctctcaaagctctgggattacagacatgagccactgcacccggctctatctccccttcctatgtgtgttagctctagaacaagagaagccttgttgagattcctggctgcccaccccccatcacctctctgactttgggcaagttgcctggcctctctcagcctttattttctttttgtgaaatggggataataatagtacttgcctcataggcaaaatgttgtgagaactaaacgagaaaatgcatgtaaagcacttggcacttagttctttttatgattataatgataatcagacacaataaattatgtctcacatcacatgc

SEQ ID NO: 388135 - DNA, 313 bp, Homo sapiens
gacatttcttctaccccagaggctggcatttctgcaggcacaaatgagcttggttttcaagcactgctctttgaacacaaggaattcctttaatgatcacgccggactatatagactttggaatcagactctttgaattccagctctgccatttaccaactttgacactttgggtaagtccttttaacctctttaagcctcagtttccttttctgcaaacaggaataatgataactaacaataataataataatcctttctcattgattaaaaataaactgagctgcaactgctattcgtatgctctcaacat

SEQ ID NO: 388136 - DNA, 338 bp, Homo sapiens
gtttccacattttatgctcacattcacatagatctaagtggccgaaacatttaactaaatggactattcatacaatcttatttccgggctggtcatctatgtcaatgataacagtagcattcatcgcatggctatgaatctgaatctttaaaaaaaaaaagagagagaaagaataattatttaaatctaaactatgctcagactagtgatttaaaagcttttttaattaaaaagtaatttaagttcattttcaaaggttcaaacaatacagaagtgtataaagtaagaattggaagtctcttcgctgctctaatctcactcctcagaggtgatcactg

SEQ ID NO: 388137 - DNA, 453 bp, Homo sapiens
tgaggtggggagaggaaggtgtcagtgctacccaatctagtctttgggattgtttgattaagcttcctaacatgattctactaccaggtcatccccttgctccaatgccagtgacaaccctctggtgcagggtctgactattacttaggtccctgtaccactctaccccttcactggcaactcctctccagccaggacactctgctccagctgctaacagattttagcatagcattatttctcaacatacaaggcccacatatgcacacagaccttgcaggggtcaaaaaatacaaaaccgacaatgttgctgaaggaataacatgcctgacattcagtttaagcactgctgctcaaaaataacctaggttggaagtggcctccagagctttgttgatcttccccaggatctcacttgcgtacgtgaacctcagtgcctggctgctccttatg

SEQ ID NO: 388138 - DNA, 407 bp, Homo sapiens
ccatcattttaatatgccctttttccaggcatttttctatggctctgtgcagatttgagagtgtttcataaaattaagatattctatgtggatggtttttattctgattttaagacaaaacattatatcattattttcctacattgttaaaaattctcttgggaggctgaggcaggcggatcacctgcggtcaggagttcaagaccagcctggcccacatgatgaaaccctgcctctactaaagatatcaaaaaaacatagctgggcgtgatggtagtgcctgtaatcccagctacttgggaggctaagccaggagaattgcttgaacccaggaggcggaagttgcagtgagctgacacggtgccactgcactccagcctgggtgacagagtgagactccatctcaa

SEQ ID NO: 388139 - DNA, 217 bp, Homo sapiens
gctcgcctgagtcctcataacatctttattgctaattaagaaaaggcggcttccttcagctgaagcagctctgagccagatgccaaaggggcaaggactagatttcagccagcctcccttaccagatgtcacgtcagctgagcacattttcagaggacatgccacctgtataacctccatgacctgtggagtctggtggccctgactccacactggc

SEQ ID NO: 388140 - DNA, 330 bp, Homo sapiens
atagcattttcatagctataacaacaaataaagcctacagagtgctttagggcttgcaaattgttttcagcaataggaaaactcatcggataagaagttcttcatgaactaaaaaaaatgacaaagatgattattttgctcaactagcaatttattccaaaaagataaagtgccctttctatgtactcccataggacgtacatgaactttcatgtattgcatttctcctagcacagcacttaccacaatgaatgtaactatctgtctacttaccggtattctctataaactataggctcataaagggagaagctgtgattcttattcacc

SEQ ID NO: 388141 - DNA, 509 bp, Homo sapiens
cttggtttgctctcttcctctctgatttctcctactctaaatctacagatttgtctttctagtcctactccataaatgatagtgttccccaggggtctgttatcaacctatcctttcttctcaggtgatctcatttatttcttcactaccacctagttttcaactttccccatatgcccattactacctgtcttagtttggttttccccagaagtatatcctgaaacagggatgtagatgcaaatcatttgttttggcagtgatgcctggaaacgccatcaggggagtggggaagggagacagggaagagaaaggagcccataaagtaaacattattaagcaagattccacaatgggcgaaaagagcttagtcctgctgggaagctccagggaacagcgtaaaacatactctagagttatcccaggcaaagggcaaatgagctgcagcatttgcacacaatccctgagagtcattttttgagggctactcccagaaagcattaattcct

SEQ ID NO: 388142 - DNA, 1836 bp, Homo sapiens
gactcggccccgcccacgtcatggcgcccgaggagaacgcggggaccgaactcttgctgcagagtttggagcgccgcttcctggcggcgcgtgcactgcgctccttaccctggcagagcttagaagcaaagttaagagactcatcagattctgagctgctgcgggatattttgcagaagacgtgctgtatagcccagaagccatcgtgtcgctggtcggggtcctgcggaggctggctgcctgccgggagcaccagcgggctcctcaagtctatgtggcccttaccgtctgcaacccagagacgtgccagctgttcaccactgagctatgccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctcgtgggaagagtttttatatgggaaagcggataaaactttcattggactggaatgtttggagaatgttaatttccaaatcaggaaccacaaactgccctctaataagacatcggctatctaagcatgtgggtgctccctttctgccagcaattctggttcttaagaaaatcaccatcaatcagacatgaaatctctggctccaaaaatagcattttctttgtgcaaataaaaacgtgtgtatcaagtatgatgttcccccaatgtggacacactcggttccccacaaagccaagcccgctgcagctgccacatccctggacacatttggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccatctctcatcccatcggagctgctgcgattcccgcaggttcttccggaactggtttagcttgcccgcaggatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattgg

SEQ ID NO: 388143 - DNA, 1807 bp, Homo sapiens
  misc_feature (14)..(14): n is a, c, g, or t
  misc_feature (17)..(17): n is a, c, g, or t
tgcaggctgtaccnccncggggtatgggatatcggtttggagcgccgcttcctggcggcgcgtgcactgcgctccttaccctggcagagcttagaagcaaagttaagagactcatcagattctgagctgctgcgggatattttgcagaagacgtgctgtatagcccagaagccatcgtgtcgctggtcggggtcctgcggaggctggctgcctgccgggagcaccagcgggctcctcaagtctatgtggcccttaccgtctgcaacccagagacgtgccagctgttcaccactgagctatgccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctcgtgggaagagtttttatatgggaaagcggataaaactttcattggactggaatgtttggagaatgttaatttccaaatcaggaaccacaaactgccctctaataagacatcggctatctaagcatgtgggtgctccctttctgccagcaattctggttcttaagaaaatcaccatcaatcagacatgaaatctctggctccaaaaatagcattttctttgtgcaaataaaaacgtgtgtatcaagtatgatgttcccccaatgtggacacactcggttccccacaaagccaagcccgctgcagctgccacatccctggacacatttggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccatctctcatcccatcggagctgctgcgattcccgcaggttcttccggaactggtttagcttgcccgcaggatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattgg

SEQ ID NO: 388144 - DNA, 257 bp, Homo sapiens
taattgcctttccatctaatggcccaaatggtcaaatggcatctactagtctcatatgaccgctgcctctctggcctcgccctgctgctgaggtcagcatgacctggaactgtccgctggtccctttcagtaacctgaagctttcaccgtagacgtgctgtatagcccagaagccatcgtgtcgctggtcggggtcctgcggaggctggctgcctgccgggagcaccagcgggctcctcaagtctatgtggccctta

SEQ ID NO: 388145 - DNA, 1686 bp, Homo sapiens
gactcggccccgcccacgtcatggcgcccgaggagaacgcggggaccgaactcttgctgcagagtttggagcgccgcttcctggcggcgcgtgcactgcgctccttaccctggcagagcttagaagcaaagttaagagactcatcagattctgagctgctgcgggatattttgcagaaggccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctcgtgggaagagtttttatatgggaaagcggataaaactttcattggactggaatgtttggagaatgttaatttccaaatcaggaaccacaaactgccctctaataagacatcggctatctaagcatgtgggtgctccctttctgccagcaattctggttcttaagaaaatcaccatcaatcagacatgaaatctctggctccaaaaatagcattttctttgtgcaaataaaaacgtgtgtatcaagtatgatgttcccccaatgtggacacactcggttccccacaaagccaagcccgctgcagctgccacatccctggacacatttggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccatctctcatcccatcggagctgctgcgattcccgcaggttcttccggaactggtttagcttgcccgcaggatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattgg

SEQ ID NO: 388146 - DNA, 492 bp, Homo sapiens
aaactaaatttctagcttaagatgaaggtgtagttcctgcactgaatagccttcatctgtagatttgtgaaatgttgcagttttacatctaagcaccttataaggaattctatcttagacaagattagatcctgtggcaatctttatttgaaaagcttcatagtttgctccaagtgcatggaaatgtgtcttatttctcttgaatgccctttaggtcttaacagaattcacagtgccaaggagtcaaaaactatatttcaaattatatacattcctgacatattatttgagcagattaaaactgatggatagagcaatttaggcaccttgaaagtagctacttgaaaaatgccaactttttcttatctccattcacttaaacaaaaatgggccaggtgcagtggctcatgcctgtaatcccagcactttaggaggccgaagcagatacatagcttgagcccaggagtttgagaccaacctgggcaacatggc

SEQ ID NO: 388147 - DNA, 790 bp, Homo sapiens
atcaccagagtcgaaaggaagatgcctgggagcctgcagtcgaagttttaagcaaacgtcacagcaaaaacagccttaaaagaagagaagacaaaatgtaaccaaagcttaccagaccacaggagggtcatcaccggagtcagaaggcggacgcccgggatcctgcagtcggacttgggtcatgccccagcatacgacaacacagcagccttcagctcctccttcgtgttccagggatacatgtgcagaattgttacataggtaagttgtgtctcatgggggtttggtgtacaaataatgttgccacccaggtaattagtgtggtcccaccctccatcttcaaatagaccccagtgtctgttattccctcatttgagcccatgcgtactcaatgaattgcatctacttataagtgagaatgtggggtattgggttttctgttcctgaattaatttttcaaacctaatggcctccagctccacccgtgtttctacagaggccacggtcttattctttttgtggcttcatagtgttccatggtatataatgatgttctttttttctagttattgtttttgatttaaagtttgttttatcttatatgagaatagaaacacctgcttgcttttggtttctctttacttggaatattttcttccgtctctctactttcagtctatatgtgtctttagtggtgacgtgtttcttttcagcagcatacagttaggtcttgtttttagaatccattcagtccatttgtataattgaagtgacaaatttattttcattc

SEQ ID NO: 388148 - DNA, 617 bp, Homo sapiens
tgagtgataaaggaaacggagaagaacgttccaagcaggagaaacggtcagaggcattgcggggagtgagtgaggacctctgctcaggctgcatgtggagtaagcggaggctggtgtggggagcagcaggaccaaggtaaagagctaggttggatccacactgggagggtctggaataccaggctaaggcatttggagttcatcctgaagacttgggaatctagttttgaggtgtgtctactatctcttaattgagacaccatggaccctgagccactatttgaattaacactgatcaagtgattggaaaacacataatataggatatttacgtttcttatagtgtgtgcagaaatttgatacctgtatctgttatgagaacctggggtagtgatgatggtaatgacgtaagggaaggtgacaaagaaagtatctatcattatgctaagtgaaataagccaggcatagaaagacaaacatcagatgttctcacttatttgtgggagctagaaattaaaacaattgaattcataaagatggagagtagaaggatggttaccagaggctgggaagagtagtggggggctgagtagaggtggaaatggttaatgggtaca

SEQ ID NO: 388149 - DNA, 123 bp, Homo sapiens
gagagagcattttagtcctacgaaaaagcacaagcagaaatgggcaaatgtgagaagggtatgtgtaaagacacactgtgttaatttcagtagagggaggagggataggaagacagtgggaag

SEQ ID NO: 388150 - DNA, 635 bp, Homo sapiens
gaaatggggaaaggtaaatattccatagggctctggcagtaaggaagggaaaaaagatgggaggccagtcatgcagccatcggccatgtggctacagcttccttcttccacctgcccagtccttattctcctgtcttcaggcaggctctcactggttggggttctggatccagagcggcaactctaacctctgttcctgaggctcttcaacccttggtgggactctgattagagtagcagcttcttcagcccaccgttccgcggggcattgtgccccaggtgttctctggttcctcctgtacctttcctggccacaccagggtgtggtaacaatcacaggacaccctgagtctcagggtcggtcatcagcctgacattctgacccccttttctgtctcttcctaatgccacagggagcctcaaatggcacggtagaaatctcagcttctaaagggattatgacattgtgccctgtggcttccttccctcctttcattccttctttccttccttccttccttccttccttccttccttccttccttccttccttccttccttccttttcctctcctctcctttcttcctttttgagatggagttttgctctttttgcccaggctggagtgcaatgg

SEQ ID NO: 388151 - DNA, 348 bp, Homo sapiens
acgcctcttctgactttgcataattcctaaaaacacagcttattattcaaaacatattttgctttttaacctgtgtcaggaacatcctttaaaaaaaattgtgggattttttaaaaagtcagtgatgaagactttttttctctctcttcagtagaccaggtatttaaaataccattaaagattagaataattaaatgaaatctgattctttttgtctattgttgacagtttaacattttaagcatacaaaaataacgagagggttttttggttttttttttttttctttgcaatgttaggatcatgtttcgtttcagtctttaaaaataacattaaaactttatatat

SEQ ID NO: 388152 - DNA, 660 bp, Homo sapiens
gaagtcctgcttgtgaaagtttgccacaaaaaaagaaaggtaatgtcaacaaaatgatattggtagattaaatggaataatttgcttaattggacatctttatgcatatatattgtattttaaagcttagttttaaattttgaaagcttaagaaatgtgttgatggcctaattataaaactgataacctcttttgccaactcgcatatctgtgtagtttttctagtcttttaataagtgtctgtacaaaactttctcataggagtctggaaatggagaagctatgttttagcatctggcataaattcagttgctgttctaccatttcaatctgttagcgtatttcttagctgtttgtacccattgacattttaggtaagggctaagagagagttttttccacaagattatcctttgtaacactgctctcaggcaaagaaattttgttgtcagcgttattagccattcacttattagtacattgcttcaaatttttataaggtgaagttatttcaccatagaaacaagtgttaagatgtttcctggtcaaccgatcaaagccaacatatgtacctttagttgcctcaagtcctcgagtgtttcaagaggagtaggagctggtctgggtccagggtcccagtgctgatattcttccaagacc

SEQ ID NO: 388153 - DNA, 558 bp, Homo sapiens
gtcgagtcggcctggggggaaccacactgcactgctgtggtgtctgagtttgaaagtgtcaacttcacataagtcactgcactgctgtcaactctgagttcaaaactgtccactgtggataagtcactgcaccactgtcacctctgagttcaaaactgtcaactgcggataagtcactgcaccgctgtcgtctctgagtttagttcaaaactgtccactgcggataagtcactgcactgctgtctcctgagttcaaaactgtcaactgtggataagtcactgcaccgctgtcatctctaagtttagttcaaaactgtccactgtggataagtcactgcactgctgtctcctgagttcaaaactgtccactgcggataagtcattgcactgctgttgtctctgagttcaaaactgtcaaccgtggataagtcactgcactgctgtcgtctctgagtttagttcaaaactgtccactgcagataagtcactgcactgctgtctcctgagttcaaaactgtccactgcggataagtcactgcactgctgttgtctctgagt

SEQ ID NO: 388154 - DNA, 752 bp, Homo sapiens
atgattgaaaaactctatctttaaattgatatatctaatttaacctagaatgtgtcagagtctatcatgtatctgcttaaaactattttccaatcatataaaagttttaagttaagatcaaggacatcttctataccctcccctgcatcttatccaacaattgcctgggttagtttaacttcccaagtatttctccagtggctcaccactgccacaactatagtccagtaagcaccgtcaccttttgcctaatgtaccagagcagcatctaacctcttctagctcttggccctttaaactgttctacccacagtagccaggataatctttacaaaacatcaatatgatcatatcactagcctgcttgaaaccttcggatgatttcaagttgctctgagagtcaaatccagtattctaatgctctctgtatctggcccttgcttaactctccagcttcatattttactcctctatcaccctcattcactctgctacactagccttctagtcatttcctcaagctgccagttcttttttgctgtagaacagagctgttcaatagtacattctatgaagatggaagtactctatatctatagtgtctggtttgctcccgctagccccgtgttgctgttgggcacttgaaatgtggctaatgcaactgagaagctgatttttaatttagttttaattacggtgaatgtaaatagccacgcatgggtagtgtattggacaatgcatttctagtgctt

SEQ ID NO: 388155 - DNA, 133 bp, Homo sapiens
tctgaattttcctagggttctggaaaattaattccacaagacatttaaacaacccatttccttcctgcacagtgtccatcttgctagggagacacaaaatcacctgcttagggttcaggaggactaggaaaca

SEQ ID NO: 388156 - DNA, 400 bp, Homo sapiens
gagcatggtggctacagttaataataacctattgcatattgaaaattgctaaaaatatagatcttaaattttcttatctcacacacaacaaaagtttgtgaggtgagagatatgttaattagcctgatttcatgattttgcaaggtatgcatatatcaaaacatcaagttgcataccataaatatatccaatctttatttgtcagttataccttaataaaactgagaaggaaaaatctttaccaaatagacatactttaaaatatatatgtggaattttcagataattgaacaataggacaaaaaaaatgaaagaaataattttaaagagataaactttggaaagctattgaaaaaagataagataaaacttgacattgacaaaaaatagctatatatac

SEQ ID NO: 388157 - DNA, 421 bp, Homo sapiens
ccggactgcagaagctggcggatattgtccagattgtgttcagtgtagacccctccgagaatggccctggttccctggcagggctgggggcctataaagtgcacatccatcctgatgccagtcaccagagggtggttcagccatctgatgcctggagcaccactgcagcagaaagcgagggaaggtgctgagctactggtgcttcagtcctggccacagcatgcgcaagctggtctgtcagggcatctgctttatcatcctcaccagtggcacactggcccccgggtcctcctttgccctggagttgcagatccctttcccagtctgcctggagaacccacacatcatcgacaagcaccagatctgggtggggatcatccccagaggccccgacggagcccagttgagctccgcgtttgac

SEQ ID NO: 388158 - DNA, 232 bp, Homo sapiens
ccactcccttgcttaaaaccctcccaagtcttctccattgcacttaaaattaaaaccaccatcctttccttggctgacaaggtcccacctggtcaagacccttcctacatttgcagactcatctcccaccatgctctgtcctctaccccactccagcccctctgtccatgctgtggacacagcaggcatggattcctcatcttttcgtggctgatttctttgatgcatccca

SEQ ID NO: 388159 - DNA, 428 bp, Homo sapiens
ttgtcagcaaaattaataagtcctttcaaaattttaaaatttcaatcctattattataataaaagcaattatctcaattaggcctatgtttggggaagttaatgtagaaaaagacggattttacagataagaaattttgtaagtgtttctttcagaagtatcagatagtgataatccctcttttaattatttcaaagaacaaaaataagagtagaagctatttaaaattttcctagatcaccctaagggtgcaggacctgggaacatgctgggagagtcaatccccttaggaattctgtttctaaggcaggggtctcaggcaccatcacatgcatacatacccaatggatgtgtcacccgctcacccatacataacattccttacagaacaatctgtgagtagacgctttctccagcaaactttctat

SEQ ID NO: 388160 - DNA, 1226 bp, Homo sapiens
  misc_feature (456)..(456): n is a, c, g, or t
  misc_feature (1089)..(1089): n is a, c, g, or t
  misc_feature (1126)..(1126): n is a, c, g, or t
gaattaatcagtgaaatgtgagatgaaacattaggaaaggagaatgaactggatgtgagcagagacaaaaaagtaaaaagctaggacatgtaaacaagattttgagttgtgtaaacaaaattagagcaaccattaaacagatacaattccctcttttgatttataaaaaatcacacagattgctcatgaaaatttgttaggaaatgtacttggaacccttaagggaggcagccacactgagtcatctctcttaatttgtagcttttcgtctgctcagagggtttcagtgtagaaaggaaactttgcagatagggaaaagtcagtattgacctagagataggcttatgtattttcttgtgcctggaaatttgtccaatcacttttaattcataggtaaggctaaagctttgagcattagtttaaataatttgcttaaataaaactataactagcttnacataaacatcaacagaatagagctcacttttattttcctttttatcttcttttccttcctgtaacacaggaaaagcatatcaaattattatctccattttatatgcaataaaaatttcctataaattttgtgcacaattatgatcacatctcctatttttacaattcatactttgagatccacttgtcttattagctggaaatctaatttccccagttgatcttatttatagagacttttttactgtagaagggctgtgtcatactaacttccataaccaagaggaatagaactggagtttgatctaatccaactagcagaagaaaaaagaaagaaatgaaaaatttttcaataatttcattaaagcagaaaagagaaactgaaaacaaaaaaacaatttaaatagaagacaaaaatacaaaaaaaaaaatcccaatatatttgtaatgacaataaacatgaatggattaactttttctagtaaaagacaaagactctcagcctggtttttaagaatgtccaaagacactcctaaattaaacaataaaaagatcagtttaaaagttagaaatgttaagaaacaaaacagacaaatgttaacaaaatgaaagcaaggcataaaagcattaatnccagacaaagcacatttcaagaataaaagatgttaangacaaaaaagatgttttaaactcactaaaggtacaattcaccaggaagatataagaggcatcaagttgtatgtacataaaatcatagcttcaaaatatac

SEQ ID NO: 388161 - DNA, 369 bp, Homo sapiens
ccctccgggcacctctacccaggatgctgctgtgcagttcctctggctagggcccacctccctagagctgaggccacatggtagggtcacctaatggaagggaggaaggcctcagggtccggggtcccctgccactgcccagctcttccagctgacagctccacatcttgggagtgggctctgatgcatgatgggtcaggggcttctcagttttctacagcccaaatactgcccagctccggaggctcctatcccaccaggagcaggtataacacaaatttttcccaaagatcatgtggtacctgctgagtggacgacaccctcaactctttcccagaggcccagggtcccatggggcagggaaacagg

SEQ ID NO: 388162 - DNA, 294 bp, Homo sapiens
ggggatactaatgcatgctaaagtttgagaaccactgacttaatatacagtttccaacccggatgacactagaaacaactacgggactttacaaaaatatgggtgtcctggcttcccccagagccactagggtagtggaaacaaatgtcactatcaaatggatctgggtttgaattctggttttgtcactcaccagctatgtgccttgtggaggctccatcttctcatctgtaaagtaaaagtcatcggacctgccttgtaggaaggtgtaggaggggaaggttcagcaatgcc

SEQ ID NO: 388163 - DNA, 230 bp, Homo sapiens
ataccagtaccatgctgttttgataattatagccttgtagtatagtttgaattcaggtaatgtgatgcctccagatttgtcctttttgcttagtattgctttggctatgcaggctcttttttggttccatatgaattttaggatttttttttctagttctttgaagaatgatgatggtattttgattctaagtgtgttgaatctgtagattgctttttccagtatggtca

SEQ ID NO: 388164 - DNA, 349 bp, Homo sapiens
cgcacctgtagtcccagctagttggaaggctgaggcaggagaatcgcttgagtgcaggaagtctaggctgcaaatgaattatgatcacatcactgcactacagcctggctgaaacagtgatactctggctcaaaaaaaaccaataaataaataaataaataaattgcatttacttcttctgaagtagtacttgtctttcattcatgtgtttatcttgccccacaaatttaaactttaatccaccacctgcaaagagtgatgggcatttatacagagcttagattgatagggaaaaggaaggaagtctaccctgtgttttattctcagtaccaattcagtgaattcttta

SEQ ID NO: 388165 - DNA, 825 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtagtcgggcgcgggatcgccagtcttcaggggccctgc

SEQ ID NO: 388166 - DNA, 4628 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgtcggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaatatgtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatacatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattatttcatatatgatttaaaggtaattaaatgttcacattttactttgaatgtttttcttctggataaaacaaatggaatcaa

SEQ ID NO: 388167 - DNA, 4652 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgtcggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaatatgtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatacatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattatttcatatatgatttaaaggtaattaaatgttcacattttactttgaatgtttttcttctggataaaacaaatggaatcaaaaaaaaaaagtcgacgcggccgcg

SEQ ID NO: 388168 - DNA, 1568 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggagggtggcaattgtcgatggagtctagccacctctctgggaatcagggcccaagtgccctggaagggagaaaacatttggcttctaggcccatataggtaaaaggccaaatccaaggtcatacggtgtaaatagtacccgctcagagggatacccaagccctaaaaccgaatatggcaaaggggcccaacagaaacaagtcgggacaaaagggttct

SEQ ID NO: 388169 - DNA, 4588 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgtcggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaatatgtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatacatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattatttcatatatgatttaaaggtaattaaatgttcacatttta

SEQ ID NO: 388170 - DNA, 5660 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgtcggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaatatgtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatacatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattatttcatatatgatttaaaggtaattaaatgttcacattttactttgaatgtttttcttctggataaaacaaatggaatcaagttgtagttgttttttttttcttctcacctaggcaagtagacttgcccattacattaacataacagcataaggtttgaggagtttattttccaaaagttgttgataaataatacctgtttcatacaaaaataatttccagaatatttaaaataggtatagtgggctaaaaggcccatcagatgtaggtaataatgtcattaagttttcattttgttcctgtcacttgcttatattacaatcactatttttttgtgcccttgccaacttgatggaaggcagggtccattgagtacaaacattcgaggtgaaatgtctctccaaaggcagatctggatgtaaatatgaggaagaaaataactggctgacaagaggataattttattgagggtgttttgaaaaggtcagctaggctagaagtagctcagggaatcttgagtaaagatgaagggaactcttttaaaacaaattcaatttatttggtcgggtagcagagcagggaggtggtgtcagtcaagcctgttttgaaacattttttgcagaaggtcagctttaaaatattgaaaaatttccagttgacatgctaagttggattaaatgctgatcatttataaaactatatagttgctgcaaaagtaattggggcttttgccattgaaagtgatgacaaaaaccgcaattacttttgcaccaacctaatactacagttgcagacttttattagtgacgctgatcttcattagtcaagttttagttattttgttggcttttccatgtagaattccaagtgacattaacatactttgattaaagaaaatttggagactgtttaagatatatgtctagatatcaatgtaaactataagctttaggaacttacatctagaagaaagcctggaatctagaataattatctcaaaaaaaagtatatataccattgtacttgatataagaaaatgtaaacatgaaaccttgacattttaataaacagtatttgtgctactctagttatttctaggaaagtaaaatatcca

SEQ ID NO: 388171 - DNA, 1387 bp, Homo sapiens
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaaggcgcctgccaccatgcccagccaatttttgtatttctagtagagacagggttttaccgtgttggctagtctggtcttgaactcctgacgtcaagtgatccacccgcctcggcctcccaaagtgctaagattacaggtgtgagccactgcgccctgcttgttct

SEQ ID NO: 388172 - DNA, 327 bp, Homo sapiens
ggagaggaaggattgggaggagcctgcagtctgtggtggggactgtctccaccttagaacaagtgggattgagcaacaaggatacccagggatttgggtccacattaagcccagtcttcacccgactgcttccctgtgacccaggggatctttagtgatgactttcaacagatttgagaaggaaaatggagatgccactagatggaaggcctgaggatggtgtctcactcctccaagctgtatcccttacctatctacccatgagcttgccagcaacctccccccgctcccacatctgtcatttcctttaactgcccacagatcttc

SEQ ID NO: 388173 - DNA, 424 bp, Homo sapiens
cgggtgtgagtaggaatccagtgactcagaattcctgagctgaccaaatcctggggctacactctgacctcagatgccctcagaaaggccccttccttggagtagcaaggggtgcttaagaaagtgagtcagaagttgtcactaattagctgggtgatcttaggtagagctcatcacctctctgggctcagtttcctcatatattaagtaacgaaggtgagttaaaaagtctgcttagaacttttcctcatttactgctcaatgagtcagtaatgtcagaactcgggctaaaaggaatagtagagacctaaatcagatttatttcaaacatgtaactaactcaacagagaagcgcaattctgctgaccatctatgagaattttctggaattgtctcaatttaaaatactgtagtttattttcct

SEQ ID NO: 388174 - DNA, 268 bp, Homo sapiens
gtcattgttgggcctttaggttgattctgtgtctttgctgcagtgaacattcacaatcacaagcgtgtgtctttatggtagaatgatttatatttgtctgggtatataaccagtaatgggattgctgtgcaatcccctttttctacgtgggttgaattgactgacttctaaagacaagactatgacagaagtgatggtttgtcacttttgagatgaggttacaaaatactgcaggttccgttttagatgcagtgactctttctggcct

SEQ ID NO: 388175 - DNA, 3343 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388176 - DNA, 3368 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaaaaaaaaacaaaaagggcggccgct

SEQ ID NO: 388177 - DNA, 3176 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgttgtaactggagctgttgtaactggagctgttgaacatggaggggcc

SEQ ID NO: 388178 - DNA, 2881 bp, Homo sapiens
  misc_feature (14)..(14): n is a, c, g, or t
ggtaccaccttctncccacgggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388179 - DNA, 2405 bp, Homo sapiens
gtcgctctccaacgccagcgccgcctctcgctcgccgagctccagccgaaggagaaggggggacaggtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388180 - DNA, 1143 bp, Homo sapiens
  misc_feature (163)..(163): n is a, c, g, or t
ataatgtatagtgatgatgaagaaaagaagcatgaaaaatgaaaaaggcactgaacgcagaggaggcccgccttcttcatgtcaagggagaccatgcagattgatgagaggaagcggccttacaatagcatgtatgaaactcgagaacctactgaagaggaantggaggcatatagaatgaaacgtcagaggccagatgaccccatggcctctttccttggtcagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagtttatgctgtacagcataaactattcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388181 - DNA, 1903 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaagcactggacatgaattcatgtcgagtgccttcatccctatctcctaacacaggggatgaagggcctgacatgaa

SEQ ID NO: 388182 - DNA, 703 bp, Homo sapiens
  misc_feature (163)..(163): n is a, c, g, or t
ataatgtatagtgatgatgaagaaaagaagcatgaaaaatgaaaaaggcactgaacgcagaggaggcccgccttcttcatgtcaagggagaccatgcagattgatgagaggaagcggccttacaatagcatgtatgaaactcgagaacctactgaagaggaantggaggcatatagaatgaaacgtcagaggccagatgaccccatggcctctttccttggtcagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagtttatgctgtacagcataaactattcccactgggagcactttgtaggcattgcatgaaccatgggatgatgattctgtggaggtattgccttgtgaatttgctgctattttagttttgtctttgctgtaaacttgtagcattaaacaatcattgttgttaatagtttacagcataaactattaactatagatcctatgaaggtaacttttcctagctgatttgagatttttatctccttttcagtttctgcggctcatatatgtg

SEQ ID NO: 388183 - DNA, 3552 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaaatccttgtgatgcctgttttctaatattttatctctattattgctatactataaaatgtatagtgtgtataatgtactattataaaagcagagggcacattttgattgaatatgaatatcacattgcatgttatgcatgtgacttgctagaaatgtagcatgatgtaatttaaaatatcttcaaattattaagtg

SEQ ID NO: 388184 - DNA, 1981 bp, Homo sapiens
  misc_feature (26)..(27): n is a, c, g, or t
aaaaaaaaaaaaaaaaaaaaaaaaanntaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388185 - DNA, 3294 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctta

SEQ ID NO: 388186 - DNA, 2065 bp, Homo sapiens
  misc_feature (2042)..(2042): n is a, c, g, or t
  misc_feature (2058)..(2058): n is a, c, g, or t
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaanggaactccaaggaaanggcacaa

SEQ ID NO: 388187 - DNA, 506 bp, Homo sapiens
atactgataagcatgtcacagtatagagcataagaggcaatgtatgtatcctagtgacattagcagtgcttttccccccttaaactcctttaaaattacttttagaacttgctgctcattcttgtgaatgttatgaatggtgtcatattgtccttttacagaagatacgatttttagaaacaaatattcattgaatgtctgccctgtgagatactcactagagtgaacatgaggaggcttatgtagcaaaatggcacctacctgcaaagaacttagtccctaatggagatgaatatataataagggatcataaatgtgctaagtggatttactagtaatatgtgagccaaggacgataaagctcctgattctgatgggtatcaggaaaggcttttcaggaagtgttacttgttataggtcagaggtcagcaaactacaggttacaaccccactgcctgcttttgtaaaaaactttattggaatacagttatgcccacttgtttata

SEQ ID NO: 388188 - DNA, 831 bp, Homo sapiens
atactgataagcatgtcacagtatagagcataagaggcaatgtatgtatcctagtgacattagcagtgcttttccccccttaaactcctttaaaattacttttagaacttgctgctcattcttgtgaatgttatgaatggtgtcatattgtccttttacagaagatacgatttttagaaacaaatattcattgaatgtctgccctgtgagatactcactagagtgaacatgaggaggcttatgtagcaaaatggcacctacctgcaaagaacttagtccctaatggagatgaatatataataagggatcataaatgtgctaagtggatttactagtaatatgtgagccaaggacgataaagctcctgattctgatgggtatcaggaaaggcttttcaggaagtgttacttgttataggtcagaggtcagcaaactacaggttacaaccccactgcctgcttttgtaaaaaactttattggaatacagttatgcccacttgtttatatattgtctgtggctgctttcacattacaacagcagggttaagtagctggaacaaagcctaaaatacttggtcttttacagaaaaaaatttgccaacctgttctaaacttttaaggtcaggagaactgggggaaggagggagtagaaagaacactgtcacccagactggagtgcagtggcaccatcatatagctcactgtagcctcaaactcctgggctctagtggtcttcccacttcagcttctggagtagctggggctactgcacctggaattgtcttaatctgttttaatactattaaaattttttttgtttcatctctttca

SEQ ID NO: 388189 - DNA, 441 bp, Homo sapiens
cctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcc

SEQ ID NO: 388190 - DNA, 585 bp, Homo sapiens
atggtacaaatttattaatatgaagaaatgcaaaatgtattgcttttgatatttctcttccgagatgaacaagtagcatgtaatgaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagcca

SEQ ID NO: 388191 - DNA, 681 bp, Homo sapiens
  misc_feature (391)..(391): n is a, c, g, or t
  misc_feature (411)..(411): n is a, c, g, or t
  misc_feature (505)..(505): n is a, c, g, or t
  misc_feature (554)..(554): n is a, c, g, or t
ggctgcaggaattcggcacgagtctacactttatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatatttaaaaaaaaaatactngttttcaaaccagtatacangataagcttccaggctgcatagaaggaggagagggaaaatgttttgtaagaaaccaatcaagataaaggacagtgaagtaatccgtaccttgtngtttgttttgatttaataacataacaaataaccaaccctttcctgcctnacatgcattcattccacatatatacacacacaaagagagttaatcaacttgaaagtgttccttcaattctgatatagaaatgcaatttaacacacttaaggattaactttttgacctttttcgtgtt

SEQ ID NO: 388192 - DNA, 1385 bp, Homo sapiens
  misc_feature (1095)..(1095): n is a, c, g, or t
  misc_feature (1115)..(1115): n is a, c, g, or t
  misc_feature (1209)..(1209): n is a, c, g, or t
  misc_feature (1258)..(1258): n is a, c, g, or t
atggtacaaatttattaatatgaagaaatgcaaaatgtattgcttttgatatttctcttccgagatgaacaagtagcatgtaatgaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttccctggatatccaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatatttaaaaaaaaaatactngttttcaaaccagtatacangataagcttccaggctgcatagaaggaggagagggaaaatgttttgtaagaaaccaatcaagataaaggacagtgaagtaatccgtaccttgtngtttgttttgatttaataacataacaaataaccaaccctttcctgcctnacatgcattcattccacatatatacacacacaaagagagttaatcaacttgaaagtgttccttcaattctgatatagaaatgcaatttaacacacttaaggattaactttttgacctttttcgtgtt

SEQ ID NO: 388193 - DNA, 833 bp, Homo sapiens
attccagttttgaacagttttagattattcatgtagattatccttttgagttcttgctaacatcagttaggctcatactgttgggcatgtgtgtgtgtgtgggggggtttatttatttttttatttgagacggagtcttactctgttgcccaggctggagtgcagtggcgtgatcttggctcactacaatctccgcctcccgggttcaagtgattctcctgtctcagcctcccaagtagctgggattacaggtgcccaccactatgcccagctaattttgtatttttagtagagacggggtttcaccatattgatcaggctagtctcgaactcctgacttcaggtgatccacccgcctcggcctcccaaagtgctgggattataggcgtgagccaccatgcctggccgtttcttttttcttttttcttttttttttttttttcgggaagacagaaggtcccctattggtgtgttgcgcccaatgtatgggatgtcgccagtgggcccaattctccgggtcactcccaactctcctcccggggttccaagtggattctccctggcgctacagacctccttgagataccggggactattagctccgtggatcctcccaggtactcatgagaagggtgccaaggttgggacacggtcacaggtcgcacaagtcattgcacagtggcccggaccgtgtaacctggacctcgaatgtgtgcgcggatgtccttgaaacctttggggacactcaggacagatttttggacaattgaccgggaacggccctgggaatccgtttaaacaagaaaaccccccaaaatgtggtttacgacgcg

SEQ ID NO: 388194 - DNA, 328 bp, Homo sapiens
gacacgctcaccgacggggtggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactccgtcggtgagcggtaccgagctgattgta

SEQ ID NO: 388195 - DNA, 335 bp, Homo sapiens
ttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgaggaggagaccaccagagcagacca

SEQ ID NO: 388196 - DNA, 1923 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggcccggtgcggtggctcatgcctgtaatcccagtcctttgggaggctgcgggaggattgcttgagcccaggagttctagaccagcctgggcaacatggcaaaaccccatctctaccaaaaaattaaaaaattagctgggaacgctgacacgagcctggagtcccagctacttgggaggctgaggtgggaggatagcttgagcccaaaacttttgaggctgcagtgagccctgatcacaccactgcactccagcctgggcaatagggtagaccaagtctctaaaacagaa

SEQ ID NO: 388197 - DNA, 922 bp, Homo sapiens
ttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388198 - DNA, 646 bp, Homo sapiens
gacacgctcaccgacggggtggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388199 - DNA, 1415 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388200 - DNA, 511 bp, Homo sapiens
tgctgatggcgtcgttcacaagcgtcttgagtggaaatcacccttgcgcagttgggcagcaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388201 - DNA, 1185 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttcttcttcccactcatcctaaccctactcctaatcacataacctattcccccgagcaatctcaattacatactaacacccacggataatcagca

SEQ ID NO: 388202 - DNA, 1073 bp, Homo sapiens
  misc_feature (413)..(413): n is a, c, g, or t
gccgggggccccttcccggacaagatggcgggcaagatagggtagggtgtagcagcgtttcgtcgaatagcacgagcaagtgagcagatgctctcggaggcagctcgatgggagtcctaggtcgccatgccaatggtgggattcgtgatgctgccgtcgtcgtggttcaccttggcattgcgtgggtgcactgtcgtgctagcaactttcgtcgtcggcatcgtcgaagagagtggtagatccgtcctggctttggcgtagaggatttaatagttaatggcgcatgggtagattccgtgaaatcttggcattgcagattcgacgctcacatcgacctagggacatagcatccttcacgctgttgcggttgaacttggaggcacttgattcgcgtttgtcgtaggctgaatatntgatcgtaatgtggctttggttgcttaccgagtgggtcggtgcatcgcttggacagcgaacccaaaggatgacgcaagttgcaagtccaagctggggcgcctgggagtggaatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388203 - DNA, 893 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgaggaggagaccaccagagcagacca

SEQ ID NO: 388204 - DNA, 333 bp, Homo sapiens
gttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacat

SEQ ID NO: 388205 - DNA, 1480 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388206 - DNA, 1859 bp, Homo sapiens
  misc_feature (1485)..(1485): n is a, c, g, or t
  misc_feature (1686)..(1686): n is a, c, g, or t
  misc_feature (1718)..(1718): n is a, c, g, or t
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaaaaaanaaaaaaaaaaaaaaaaaaatttgtgggcgccgggcccaaaaaggtttaaaccatttgtttgggggccgggcccctgggttttgaccggggcagggatcaaaagagaaccggggccagccagcggtgggtcccccccaaataaaacccgcgcgggacggcggttgacacaactcagcgggctctgggctccgacttccaccnggccacagccaatatccgccccggcgggggtnaaaaaaacaacaacaacacaaacacagaagcacaacacgacaaaaacaagcgcaacacaacaacaaccagaagccaacacaacaagtaactagacaagacacgacgacaacaaacagcaaacaaacacacagagacacaac

SEQ ID NO: 388207 - DNA, 1478 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctttttctctctcagggcaccccagccccacactcacatgtacgaagttctcaccccagctcctttgtgtggcaccctgatgagtatttaaagcccg

SEQ ID NO: 388208 - DNA, 1488 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccaccttcaagccacgatgcagttcttgtctcgggcctgacgaggcatccctgcgcgagagtccctggggagcgataaagatggggagttgaaggtctccattgcagtgtcctgagcaggcatgggcctgcacaaatgcgggggcagagggatgcgctctc

SEQ ID NO: 388209 - DNA, 1289 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactccctaactccccacttccctcattttgtgacttaggtgggggcatggttcagtcagaactggtgtctcctattggatcgtgcagaaggaggacctaggcacacacatatggtggccacacccaggtggtcgactggtagcatgagtggaccgcctga

SEQ ID NO: 388210 - DNA, 1405 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcagggtactgggctaatcgtagtgccttggtagagctatgtacttccgtcggagcagaatagagccatgccgagatggccgtgtaggacttcctcatctcctgaactgaatactctcatgaatatctccaccacaaacattcagcagcaattttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaa

SEQ ID NO: 388211 - DNA, 1434 bp, Homo sapiens
gacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccag

SEQ ID NO: 388212 - DNA, 391 bp, Homo sapiens
aaaacgtcccagtcacgacgctgatgaacgtaccagggatgagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccgg

SEQ ID NO: 388213 - DNA, 495 bp, Homo sapiens
gtcgctggggctgatctagaggatcccaagctcaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttactttgacttcttgttgggagcttaagctcccaacaagagttccatgctagtgatggagatgtggaaaccaggtcaaggtgctgacttggggacgtgggtggtgactggggcatgtttcagttgaggtgcttgttcctccggtggggagggattgagaagaatgtgagttgcccatctaatttggcaagttgtcttgtagggagctt

SEQ ID NO: 388214 - DNA, 371 bp, Homo sapiens
acaaacaaagtctcctaatcttggacagctgcgcccagcccttcttcacctgccgtccagatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggaagaccccggggcattttacaaacgga

SEQ ID NO: 388215 - DNA, 4169 bp, Homo sapiens
ggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388216 - DNA, 4293 bp, Homo sapiens
ggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagagacagggtctcattctgttcctcaggctggagttcagtggcacaatcatagctcactgcagcctcagactcctgggcttaaaggaccctcctgcctcagcctcccgaggagctggaactacagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388217 - DNA, 4086 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttccaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388218 - DNA, 3964 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388219 - DNA, 1896 bp, Homo sapiens
  misc_feature (73)..(73): n is a, c, g, or t
cagatataagtgtcaagggaaggttaatggttgatattgctagggtggcgcttccaattaggtgcatgagtangtggcctgcagtaatgttagcggttaggcgtacggccaggactattggttgaaatggtcgccacggattggcgaccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388220 - DNA, 2636 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagtaagagggaatttcaaaattctcttacctgtcatctcttgctaagaaaatatcagctttattgtgtagtaccgtgaagtatcatatattctagcaaattaaattctagaattattctaaccagtgctttcagaacatttgtagatgtt

SEQ ID NO: 388221 - DNA, 2308 bp, Homo sapiens
  misc_feature (242)..(242): n is a, c, g, or t
  misc_feature (276)..(276): n is a, c, g, or t
  misc_feature (309)..(309): n is a, c, g, or t
aacacctctaaaccatttgattaggtttttatgagccaagttcttacatattccattcatcatgaccttttagtcaatgtagcaacagggattccaacattttgctaaggaatggcccgctagggaaacttttaaatgttcatttaacttagttttgtttagctagttaaaacacactagcatttgtctagtttcctcatctggatgaggaaacctgctgtgatggcagtgataaaattttnccttttaggaatttgcaaataaaccactgcaatnatagacactttaaaattatccaatttaaattgncctatctagaattacttatttcacttgaaatgtatggtttcaggaaaattttcaatttaacttgaagggattatctcttattttgcttggaataatggcatctcagaaacatgggtttacctgtgatttttttgtttgggtgaatgcttaaaaacaaaaaaaaatttacatatgcattttatggatacacacacacttctatatccattttagggtctttcttatccagcaaaatactttgtttccatctgctaaggtgaaataaatacgtggaggtaaaccacaggaaaagtgatttgtttttaatctaggagaaaaactagtattctagataagcatacaagatctgtgtactaagaatacattgtctctggatttatattctggtcataatataggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagtctgtgtttctattaagtattattaatattttaaatgtaaggaataaataatgtgatttagtaatatgtattttcttctctatgctaggtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388222 - DNA, 953 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccacctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388223 - DNA, 250 bp, Homo sapiens
gtgaatcataccatattcctatgtgtggctgtaactttgcgctagttattttaaaatagtttttgtttattttgatcttttgctttctttttgaaggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatg

SEQ ID NO: 388224 - DNA, 649 bp, Homo sapiens
  misc_feature (73)..(73): n is a, c, g, or t
cagatataagtgtcaagggaaggttaatggttgatattgctagggtggcgcttccaattaggtgcatgagtangtggcctgcagtaatgttagcggttaggcgtacggccaggactattggttgaaatggtcgccacggattggcgaccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtggtcgccaatccggggtaccgag

SEQ ID NO: 388225 - DNA, 501 bp, Homo sapiens
aaaagaaaaagctttacttgcaggagtactgattagacttcgagtatatcatgcgcggaatgcctcactggtgtgccattcccttggctttatgggttttttctgtgctgccccaaacacagatttagtcagtgacatcctaatccacgggatgaaggctcgaaaccgctcaattcatggagatgtggtagttgtggagctgcttccccgggcgtgatggcaggcgcctgtagtcccagctactccagaggctgaggcaggagaatgacgtgaacccaggaggtagagcttgcagtgagccgagattgcaccactgtactccagcctgggtgacagagtgagactccatatctcaaaaaaaaaaagaaatgcaagtaagacatgtgtaatacttttcctgtacccaaggtgaacatgacccaaatttgctgatctctaatttcatgaactataaatgggtttcattttataaaataattcattttctaagacatttttgag

SEQ ID NO: 388226 - DNA, 4141 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388227 - DNA, 4040 bp, Homo sapiens
ggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388228 - DNA, 3957 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttccaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggttatctcgtctccaatcagttctttcaaatgttttatttttccagtaattacgtttgggtcataggcccctctgacatttgtcaggtaattttcagtcactttcagataataagacttagtcctgagtccacttctccacttaaaaattcctatttcatatttgactcaacccttacctgctgtctccagtactagctgggattaggacacagggcgggtggtaggatgcacaggtaaagttctgtcacaggccttccttcccactctcccattttgatgaggtgcattggccttccccttgttggaaacttgttactttgccagcaaacaccccactagaaaaattaactctaggccgagcgcagtggctcacgcctataatcccagcactttgggagtccgaggcgggtggatcacaaggtcaggagttcaagacca

SEQ ID NO: 388229 - DNA, 2787 bp, Homo sapiens
acaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaacggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttgggtgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagtggaaatgtaaagattcaagcaacgcataaagatatgatgacagaggccagacgtggtggctcacttgagggcggatcacttgaggtcaggaatttgagaccagcctggccaatatggtgaaaccccatctctacaaaaaatacaaaaattagccgggtgtgatggcacgcgcctgtagtcccagttacttgggaggctgaggcaggagaatctcttgaacccaggaggtggagattgcagtgggccgagatcacaccactgcactctagcctgggtgacaaaattgagactgtgtctc

SEQ ID NO: 388230 - DNA, 439 bp, Homo sapiens
tctgtatgagcctagattttcttcaaatactacagcctagaaaacatgttacgacccactgaatgcagaagcaagtggagaattcacccatcttctattgttccagataagggaggagaccacccctcatattgtcttatgcccaatttctgcctccaaagaaaaaagaagtaaaaactaaaaggcagaaatgaaatccacaggcagacagcccagcgccacaccctgggcctggtagttaaagatcgacccctgacctaatcagttatgttatctatagattacagacattgcacggaaaagcattgtgaaaatccctgtcctgttctgttccattctaattactggtgcaggtgcatgtagcccccagtcacgtaccccctgcttgctcaatcgatcatgaccctctcacatgaacccccttagagttgtaagccct

SEQ ID NO: 388231 - DNA, 858 bp, Homo sapiens
tgctaggattataggctggactccagatccaaacttgacatgtagcagacccattaaaaacatacattaagcccctagcactgttttaatctccatggcctggctgagcttctgccatctgtcttcctaggcaccatgaggtctggacatctcatttggcataactcagctgtggccattggtggatctcatccttagtactagtccctgctggcaggggtgacccaggcccacataagccattgctggcctccttggaggacttagagaatcctgagattgcccatgaggatggacatgcctttcagtctagcacccacctttagtgatgcctgtggagattgagaagctcacaggggccttggatgtctttcttatacctccattgtctgcagcgtgactcccatactcttgagccaaggtagagaatttttaggaggcttgtgtggaggtttatggtggcccccatggttctgtgagactggtagaaagcacagaccccttagacttctccccaaggagaatacgtgagactagtggaggaaaggagagtaatgaaatatgcatttcgtgtcccaggctatcagagcacagctctaaggaaaaatacagggcatcgtatagcaactggcacagctctgtgagactgggagatattgcacaaccttgaaaaatcaagatgtgaccctactgaatgaacaaaataaatctccaataattgaccataaagaaatacaggtttctggctgggtgcggtgctcacgcttgtaatcacagcactttgagaggccgaggtaggcagatcatttgaggccaggagttcaaaatcagctttgccaacatggtgaaatacaaaaa

SEQ ID NO: 388232 - DNA, 453 bp, Homo sapiens
ttaaataaaggaaatagttagaggtttggactcgggattgtttggtttatatggtaaaggtatagtttagtttagccagctctgaaagagctggtctccctagcccacaaggtaccccagaaatgtcaaaaccatataaggtatataaaataaaaattagattaatacagttagttacttagctcttcagaatgtcaaaaagtgggaaacagcctcaatgttgtataattaaaaagttagttaaatgattgctggaatagtattataataagcaatgtattctcatagacgtaatgcaatatacgtttctgcttccagaaattgccgtgggaataaaaaaaaagcataaaatatgttactgtgtctctctgtgtatacatgtatgtttatatatgtaaatagaagaaaacttacctctgtatagaaaatttgtaagaataaagctttaaaata

SEQ ID NO: 388233 - DNA, 884 bp, Homo sapiens
cccagaagtggattcagcacataaggacgttttccacatccatatgattacatccccaaccggtcagcagcacccattctcctgcctgccaaactatccttgaaaaaccctagccttcaaatttctggggagactgatttgagtaataaaattcaagtctcccatataaaaacaacaaaaaattttttgactagaagggaagctgctgccctgaagataaaagaccccaggcctgacaggatttatcacttgctgactaaagagcccttgggctttgaataaacatcaacaatagacaggaattagtctctacatgctttgggtgagacccagtactgtcaggtgtgatctagcacagtcttagcagtggtggccatgggagtgcttgcatcacctctaccccaactattaagaatctcagcacagagagagagagtgagagggaaacttcatttgtttgggggagagtaagggagaagaacaagagactctgcctagtaatccagggaattctcccagatcttacccaagttcaccaaggcagtacctctatgagttggcaagagtcacagttttgctgggcgtggtggtgtgtgcatgtagtcccacctacttaggaagctgaggcaggaggatcgcttgggctcaggagctctgggctgtaatgtgctctgctgattgggtgtctgcactaagttcgacatcaatatggtgacttcctgggagtggggggccaccaggttgcctaaggaggggtgaactggctcaggttggaaatggagcaggtcagaactcctgtgctgatcagtagtgggatcgtgcctttgaatagccactgcactccagcttgggcaaccatagtgagactctgtctcttaaaaaaa

SEQ ID NO: 388234 - DNA, 649 bp, Homo sapiens
ctttctgatgattttacaaatggctcaattagtcaatcatgtgcaataattcatttaataaacattttttgagcacagactttgtgttagtactgttacctgttgtaggaaatttgttctaagtcctggctgcatcatgttacttagggaactttgaaagaggctctttactcctacactccatccctggtgattctcatactatagggtaaggcttgggacctgggaagtgtttgtttgtttgtttgttttaaaaaagctctcatagtaatactagtgttctgtcatgcttcaagataaagagattgtcctttcactagactggatatatcatattcttccttttctttgattaatatctttgtctctgtttttttaaattttttgtttctattcacaagaaaaaaatagaaattgggagacttgagtagcttattttcaagtttaaggaatgggaaggcacttcaatatagattatcttatttcactcaataattttgtaaagtaaatgttattatttcccttttttccattgagcattgaaggtttttaaaacttacagaaagccacaaaacgagttaatgttagaatatggcttggaatccagaggtgtgtaactccagagctcatattcttttcccttaattaa

SEQ ID NO: 388235 - DNA, 2023 bp, Homo sapiens
  misc_feature (1730)..(1730): n is a, c, g, or t
tcaactactgaaaatgcttccaaaaccaacgactaatcagaggaaacctgttgcacagcaactcaacttgagttaaacaagtcttggcagatatgaaaaaaataccttgaatcataggttgtaaaagtcaagctagacatgcacaatagacaagaagatgtgaaaatagtattgtccaaactcaagaaaaaaaaagacaaaattatctcagtggaagactgaattccaaggtgaacaacaggacaatagactcaactgaaaatgtaataagggacattaaggagggaaataaaaagccaagagaataaaaataaatattagaaaaggttaaaaagtatctcaaaggaactgttagatatagaagataatgaacaaaaatccaatatgtatatgtacacgatatgtatatgtatgtataactgaaaacccaaaagaagataaacaaaacaatggaacagaattaacacttaaataagaaaactttccaaaaattaaagcagacctttacctttgtatttataggacctacttttgattcagattggtcaactctaagacatattttagtaaaactattgtattctaagaaaatttcttctaaacttctggcaaaaaaaaagccaagtcttttacaaggtaaagaaagtcaagtttgcagctgtttttcaggtattgaggttatactgaaatcgttttcagcatgcagaactcagggaatattataaccccaagcccattctgaggaattaattagagaaagctcttcatcaaagcaagagatgatcaatttaagacaaaaacaaagcaagggacaagggtagaatagtgtatgtgtgtatcaggctcagtccagtgaagagagaaacaacacagtaatttgaacatagaaagtttaatataattgttaactataacagaggattggagtaatgagggatcagttagtaaaggaaagataactctaaagaaattatatgagtagcaaacataaagaaaagccagactctgaggctgagataaagtgcccaaggaagagcctctcctcccccatcctgagggctgaggtatagggctgtgttctctcaatgacagagaaatcactgtggtgctatgttggtggaacttgctaggaactcccctctatggtgctcaggaaagctgttcgttgagagatatctctctacagtaactctactatgaaaccacccaaggtgagggtaaggatgctgctgcttagaaagagatgcagacaaatgtactaatgaaggctcaacacagctctttcaaggcaagacaggtcaagaggacaaaaagtaaaagtatgaaaggctttaagaaatcaggtagatcgtaggtgtatgtgtgtgtgtgtgtgcatatgtatgcatgtcaaactttagatccttataaatgatctgccttgaaatttaaaaatctaaatagctcttagttgaacaggggagatataaacaaagtttgcaaaattcctaaaacacgatgataataaacatcatacatcagaattttgagatataattaaagcagtacttagaagaaaatgtatagccttaaatatttaacatcagtaaaaatgaaaggatgaaaattgggatttaaattcccaactcaaagagctagaaaaagaattacaaagcaagaagaaaaaaaagataaaggaaattaatgaggcagaaaacagaaaagcaataattcaaagttaattcaaagtnctggtcctggccgggcatggtaattcatgcctgtaatctcagaactttgcgtggccaaggcaagaggatcactttgaggctaggagttcaagaccagcctgggtaacatagcaagaccctgtctcaacaaaaatgtttttaaaaattagcccagcatggtggcatatgcctgttgtcctggcttttaggaggctgaagcagaaggattgcttgcacccaggagtttgaggttacagtgagttatggtcataccactgcactgcaacctaggccacagggtgagatactgtctc

SEQ ID NO: 388236 - DNA, 802 bp, Homo sapiens
ttgcaccattgtccagcctgggcaacagagcaagactccatctcaaaaaaaaaagtgtatttgtttccttaaaaaaatttttctgaaaagtgggtaatgacataatacagctttcaaattactttatgctgttattttattcttattgtattcacatgtgaaagcatgtgatcaatttttgctgcatcagagatattagagatagttttttattaattgggcatttatgaccttttctataaaagtaaggacattaaaatgtaagatgcatgatgaaaatataagtggagaggctctttgtagttaacctatatgaagtaatgtataaggtaggtcagagtaatacttttctacattatagtgcaagaaataattattgataaaagtatattaaactaaattcgtatattttacttattgtacttttatgtaataaaatgcagtgcatttaaaaattgttagattatgtgtgaatttaattttatgttttttaccatgttaagactattgtgcatttaatgaagcattattatgccactaacctatcccaccttactcaaaggtgtaggtaaaagatggtagcaatatactatttggtacataatggaataatgtctctagtaatcactttgccagtggctttaaacagcaaatgaatttaagaatattgttcccataggttaaatttttattctcttttcttactgaaatttattattagtatttgtgagtatatagtatatgtatatatttatgctttatatggcatattttgattcaggcctataatatgtagtaacta

SEQ ID NO: 388237 - DNA, 643 bp, Homo sapiens
aggtgcatttatacaaaggatcatccagaagacacctaactgcaagaaacaatgtttttggcagcaaataaaagaggcttccttctttccttccttaacatgtttgttgagatataacatacaggaaagcacacaaatatttttcagtttgataaacttttgtgtaaccactattcagatcaaggtacagaatcttttcagcagcccagaaatctccatgtgcctctttctagtcattagctctcctccacaaagaaagcttacttcagtaatgaaagtctaccctgggccctccttccatcctcagaacttcctgcaaagaaatgatccaagaaagcccatctcatacaacaataagtaataaaaaagaaagtaggatcattggtagattagaagcaatgatattagggggaagaatgtcagcaagagccacgaaaattacccccaaataaggaacattcccaggaaaataatttcagggagcagatgaaaagtctaatcaagtatttcacagtgaatttaaagaactcaacaaagcaatcatttctgtgaagaaagacccaacttgcagaggtaaatgcttgggaaaggatgacaaaatggcaagaggtggtgaaatgtgagctggcagaactcaaggagg

SEQ ID NO: 388238 - DNA, 405 bp, Homo sapiens
  misc_feature (11)..(11): n is a, c, g, or t
atgcgcgcggngacctgaggatcccctcgcgacgtgtatcctaaagccaaaatcaggcaaagacagtacaaagaagcaaaactaaagaccaatttcctaagtgaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtataacatgttcgcgaggttgtcagcttaaaatagactattaacactataaga

SEQ ID NO: 388239 - DNA, 678 bp, Homo sapiens
ccatgtagggtttatcccaggaatgctacacttgttcaatattcaaaaaatcaatcaatgtaatctaccatgttagaagtctaaatcactggtcagcaaactacggtccagaggccaaatccagtcctgtacttggtctttgtaataattttatcggaacatagccatgtatatttgtttacatacagtctacatctgctttcatgctacaatagcagatatcagcagttacaacagacagcatattgccagcaaagcctaaaatatttactatgtgaccccttacagaaaaaaatgtgggaggtcaccaccattagacctgccttacaagaaatgctaaagaaagttcttcaaattgaaacaaaagaactctaaaaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtataacatgttcgcgaggttgtcagcttaaaatagactattaacactataaga

SEQ ID NO: 388240 - DNA, 1324 bp, Homo sapiens
ggtgcagagggctctttgggggcagagcgggcactgcatggaccctgcaccctggagctgatgttcagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 388241 - DNA, 1127 bp, Homo sapiens
aggcccccagagtcacagtgtctatgctctcctggcccaggggcccaggagctcttccttccctgtggccaagcggaggcagggctgtgtgggccaacaagatgctgtttccagggtgaagctctcagcacacgaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 388242 - DNA, 208 bp, Homo sapiens
atcaagagtttctcttcatgccccccaaaaacttcaagtgccatttttattcatctctgtgtgcttttaggtacggtcaaatgaagatagatttgaagatgatcgatattttttgggtttcttgtccaactcaaaaagatttaatgttgcaatcaccagacccaaagctttgctgatagtgctgggaaacccccatgttctcgttcga

SEQ ID NO: 388243 - DNA, 371 bp, Homo sapiens
ggagcagagtcaggcttggaagtcaggcaggcctcacgtttgctgtgcagagccgcttttcgttcgacagaaactgtgccgggtaccaccttccccttgtgacccatcaccatctcctcgcaggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcgggtgagttgtgtcttgaatccgtaggtgaccgtgtcgggtaaggacagtatggcaggaggtccttcctcccaggt

SEQ ID NO: 388244 - DNA, 3924 bp, Homo sapiens
agcggggcggcggtgacggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcgctttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctttgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 388245 - DNA, 4251 bp, Homo sapiens
agcggggcggcggtgacggcagcctaggccgggcgagggccatgctgagcctcgcagccaagctggtggccttcttctggaggacggcggacacccctagggaggaagccgggcagctggagcccgagctcgcggaaggtggctcgcgggaggcggctgggaggcgggtcccgggccctcgcgtgtcggccacgagggagccgcgcccataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttccttcctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcgctttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctttgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 388246 - DNA, 4113 bp, Homo sapiens
agcggggcggcggtgacggcagcctaggccgggcgagggccatgctgagcctcgcagccaagctggtggccttcttctggaggacggcggacacccctagggaggaagccgggcagctggagcccgagctcgcggaaggtggctcgcgggaggcggctgggaggcgggtcccgggccctcgcgtgtcggccacgagggagccgcgcccataggtctttgagtgcagtgcgggccggcaggcaacgctgggcccggcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctccatgtcgttccttcctgtccgcagcgtcattggcggtggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcgctttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctttgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgacccccaaaaaaaaaa

SEQ ID NO: 388247 - DNA, 605 bp, Homo sapiens
gaaacccctctggccatctggaggaatcccttttgaaagctcagctcaaaggttcacccttcttgaagcttaccctgacacccactcctatatttaccccttggcccccagacttccaatattaaatatgaaacacttcagtgaaccttttacacacccagcccttttcctggacctccaagcctcaaggcaaggataaacatcatgaacactggaaattattcaacagcccagccactgggctggtggaaaaaatatagttcagtcagtacctgtgtagcagcgaccgtatcagattgtttatattcattatctccacttcatagactaagaaactgagacacaaaatagaagtaacttagccaaatctggcaagaagaatcaggactcaaacacaagggtcttttgtctttttacttcaaggtgttactaaggtctagtactatccaatggaactttctgcaatgatgggaatctctatgtatgtgttgtatatgctgtatgtctatatatgctgttatatatggtacagtcactggtagctgttaagttgccagtgggactggggaactggattttaaactttatttaattgtaataattaa

SEQ ID NO: 388248 - DNA, 701 bp, Homo sapiens
aggacctgcactgattggtgataggcagcatgggctcaggagagcagggagagttaggggagacacccacgtgcctggaatagtggagggccatttggagcaagcctcagatggagagccacatatcgaggtgttcggtcaatccttgtgaaccagagagtgttcctacgaatgctagagtctcatagaagtaatgtctcttttacgtttttttgcctgattaatattttcttcccctcccggtgccttcaagtatgaatgacaataaataccatacatataaaaaaaaagaaaaaaaaaaaaaaaaaaaaaaaaagaaaaaaaaaaaaaaaaaaaaggggggggggcgcaaaaaaaacccccgggggggggccaacaagctatcgagaagcgccccaccgacgcctttcgtcgtggaacaaaggggggcggcccatattaagggggcgcgcgattatataaagccgcgcgagaacggggaggcggcggccactaatcaaaagaagcgccgtcgccgacgtcgggccggaaaaaacaccgcggaacggcgacgtgggggaacatcaccctagcggcagaagagacgagcacccccccacctccggggcggggggaggggagcacaccttggtgcgggaccacacaccaagcccccaacgaaggattagaagagggccccgcggggggaccgaccacaggcc

SEQ ID NO: 388249 - DNA, 285 bp, Homo sapiens
ccagaatgcaaaagtctgaaaaatatcttaaagaccaatcttaggttttacaacagtgatgttatctataggagtaattggggaagttacaaattttgtaacctccagctacatgactcttgatgagtaagcaattttagaaaagtaagctagggaacgggctgcgcacagtggctcacgcctgtaatcccaacactttgggaggctgaggcaggtggatcatgaggtcaggagatcgagaccatcctggccaacatggtgaaaccccatctctactaaaaatac

SEQ ID NO: 388250 - DNA, 621 bp, Homo sapiens
ttttacttctgtaggcatttacccaactagaggaaagggaaacggagggggcagggagggctgctcgttggcaaacgattaattttgagacactattgctcagggtctgagagcttgaactctgaattcgaactgttagcacaatcgttctcaacttcggggtgcataaaaagtaacttgaaggtggttaaacgtacaatttggggggcctcatcccccaaatttatttgaatggagcagaggggggttgtcatctttacattttcaaatgagcagtcctggggctgagactgattaatgtaaccactacattgagaattactggtctaacataaaagtgttcaagatgttgaaacaagtgacaccttgtgccgttgatttccttcccttttccagagctgtgttggtggtgtatctcaaactaaaggaggtaacagaatggactcttgggacgaacctgatttagttagagtttccactcccatcttgaactagtggtataatgtaggaaagcagttctcaaagtgtggacagatgacccatggggatctcctcttaccctttcagggtagcctcaaggtcataactattttcaaaataatagtaagatgctatttattg

SEQ ID NO: 388251 - DNA, 572 bp, Homo sapiens
tacaaagtgatccatgcaaaagtaagtacaggaccttggaaggagcctatgcaagtttggaccctgaagtttaaccttactggcttcatggtcaatctgtcttttgctcaaagaccttgaactgaaacctggagtgatgactgagaagaatatagcagggctgcttggctctttggaccaaaaaagagagaccattttctataaaccttgcctggctgacggtccaggttaataaagatgtaaaaatggtagaaggtgtgagaatatatctaagaacaataacaccaacaacaaatcaagggggattatcctttctaaaccttgactatgtcatctgtgagatgtgtagggaagctgcttctgccgtgtagaggccttgaagagtaaggatactggcaggatgcctgtgcactgatgttacagagtcttagcagagggcagaacggtctccttggacaacgtggacctggctgaactacagcactggggaccacttggtgcaccactgcccagggcatggttttgtttgtttgtttgtttggcttattgtaggatggcccagagattctaaa

SEQ ID NO: 388252 - DNA, 319 bp, Homo sapiens
cttgcagggattttgcttcttggcttgttttgttttgctggaatgaatgaataagtaaatgggaacgattttgacttcaccctaagcctagctaaaagtttgggtagtgacagttttggttattttgtgtaacctgatagtggatcccctttctatgccaaaaaaaaaaaaaatcccccaatactagagtacctgttttcctagggaattgacctcagcaactgaaggagaggcgattcaaagcagggagtgtgatgaataggtcaactctgtcctcgcagccgtccctgagagggcgctgttcccaaatcgaagcccc

SEQ ID NO: 388253 - DNA, 247 bp, Homo sapiens
cagacattcaataaatatttgatgaactaacaaatgtgtttatttttactatatttttaatagatatctcagaaataaattttaggatctagaaacaggtactaactgatactggtgacctctgaatgaaaccaattcaaagttcgagacctaactgaaaagaaagtaatgattaagacaaatatatacggggaaaatggtaagatttctgtcatcttaacagctaaggacatcagaactgtatcaa

SEQ ID NO: 388254 - DNA, 581 bp, Homo sapiens
agggtgcatctgccaaggtcgtgttcactcacctaaagggtgcagaaacaaggggggagagaacgagtgacgacactaggtgatatctatgattttaaagaaaagctgaatgtttagagcttccatatttggctacgtacttcagttagcgacggaaaatagtttttaaagctttattggggaattaattttttttacgttttttgttgcttctagccccatatcctactgatttttagcatgctgcggtcagaaataaacttaattccctatagctgccgcgattaagcgtagagtggcttgcagtttcaaaagctgcttttgcatcaaggcccaagctccgtgggtctcctgctaaaacttttgagcctgtgatctgaattcctaagtgtataaaattctagaatagtgtcttcgagaattgagttgcgttcattttctggtgtggaccatgaagtcaacgttaatgaattgggaataaggtggcttctagttgttttttgttctagtagcttattcagcttggaggcagagaaccttggaatctctgttaaattagtctgccatagaatggaacttga

SEQ ID NO: 388255 - DNA, 756 bp, Homo sapiens
cctgaaaaggctgttaaagatacatctgccttagaaaagattagtggttatcaagagttagagaggtgaggaaggagaaagggaggaaaggaacaagtataaaaacagtagcatgagagacctgtgggatggaactgtactgtgtcttgactgtgatgatggttacataaatctgcatatgtgataaaatcacatagaactaaatatacacacacacacacacacacacgaatgtatgtaggactggtgaaatctgaataaagtcattggattttatcaatgttgacttcttagttgtgatattgtatggtaattatgcatgattattgcataattattgcataataattatgcataattccattggagaaaatcaggtgaaaggttttaggattcctctgtattatttcttacaattgcatgtaaatctacaactccatccaaacaaaaagttaaaaaaatgctttgccttttgcaaatacatatctttatgaggctagaatttctccatatacttcagccaggacaatatattgcaacacgttgaatgcagaaacatataagacaatgcagctgtcttctattaacccaggcataaaagaaatttataaacatatgaaacaataccagtcaacttacctatatgttttagtttggggaaaatgaattatttctaaaaatgtatttaatgttaccatgtaatggaattattaatgttatctttaaaataaagctataaataaatatttaaaaaaa

SEQ ID NO: 388256 - DNA, 104 bp, Homo sapiens
aaaatcaaattgtaataaaattcttttaattttaacacatatgtaatttttgtaactgtcaccacaccacagtcgagatatagaacagttccattacctaaaaa

SEQ ID NO: 388257 - DNA, 284 bp, Homo sapiens
caaactgcaactttgccacgttcccaatgtgggatcttgggcagcttgcttaaccttttggaacccagttttcccactacaaaatggggatatttacacacatataagaatttacataagtaacaatgttcataaatttaggaattcatcatttaccagatattctctatgtgccaggcactgtgctaagcaccttgcatgaatcattttgtttgatctttataataacctttcaatagaggaagcattatctctattttacaaataaagaaacagaggctcag

SEQ ID NO: 388258 - DNA, 3616 bp, Homo sapiens
  misc_feature (1845)..(1845): n is a, c, g, or t
  misc_feature (1848)..(1848): n is a, c, g, or t
  misc_feature (2150)..(2150): n is a, c, g, or t
gtgatcatagttaaataataatagtaatagaaaaaacaggtttgaagtcaagcataactcatttaaatcatatgactgtcactaattagctatatgatcatgggactgtcaatctctcagagtatctatttcctcttttatgaagtcagcataaaaatccctgtttttagagagtttttttcgtaagattgattaaaataatgaacataactcacctggcatatactatgaatggaataatgactggtatgaatttatgataatgatgatgataaaggttgttccttcctatacagcatcagctgaaattaatttgacatggtcccacaagacaagctgaagattattcaagttaacctatggaggctttttcttaaatgagaacaagtctacctttggtggttttcttcactttagcaacatcaaatcatatcatcctttagataatttcatataataccatgaaatgctatcacacagaaggtaaatggggataactgatgtgctatcaactctgccacagagttgtattactagtgttcaatgttgtaatgatagagaaaggactggacgagcgaggtgagagtaactgctgggaaatatggtccaagtgctcctggtcttctctactgtctaccttatctctgtagataaaggtttcaacagttcttggcaagtctctatgaactcggccaactatgcacaaaagaactggtatcaattttaatgtagttaatatattatgtaagcagtttagcctagttctcttaagagcatggattttaggtttagctgaccactagctctgccacttacttcatgtataccctcagacaaattacatggcctctctaagcctttactttcttatctataaaaatacaaatgataaaacctacttcagagggccattatcagcattaaataaaataatctatgtaaaagtctcagtctggtgccaggtacatagttagcactcaaaaattagctaatatttacctaccaaaccactaagtattacttacatcaaaagcaatctctactgagcatgacatttttttcacaaaagttcctagagggaattaagaggtcatagaaaacgaattgggttagaacattcatgcactcatcactaccaccatgcagaagttgtgcaatgtgaactccaaagtgtgtaaaggcttcatttcactgtgtgaattcaggtggtaaatactacggatatttttcaggttatttgcatatttattatttcttttaatagtattaattcttactccaatgtagccctgaccgtgttactgacaatgttgattgaataggtattataagaaatgctaccaagttccttagtgtgagtcctacatgtaccctttcctgtcactattacttccaactttcgtggtatttctgacttccagctgtaaagagcccatgaaactatggtttctctacttgtcctttttgcctcagcctaagaaacatatcttgtgatttacaagaagacagtcaatattatggggcagcttgattgctatcctgcacagaggcgtgagaacagacttgactgcatttcaaggacctttgaatctaaccttgtaattctacttgttgtgatgtatttttttccacaagagatatctgagtgtgtgatacactagttctgcactgtgctaggcactgcagggagatccaaaaattatgaggtagaacccatgcttcagaaaagatgaaaattaactgaggagacagaactcgcaaacataaaacaatcagaagaataggctaatcatgttctccttatggaactcaaaaaaaaaaaaaaaaacaacaaaacaacaacancanaaaaaacgacctctctatcattgtttttcatcttaagtctgtagcttaaggtgtcaatagctgattttgctactggctatgctccaaataaatctctctaagaaatgacttcccatttctgaaaatgtttccactgccatattttctcacacaaaaaaaatgaaactaaattggggatttctaactaatatcctgagtgtaagcaatgttttttctcaaaataacatgtccattatccagataccacactggctttcaatggcagaatttgaatgtcttcataaattttcctattctatagnacaaggcttatatccgaaatcaaaatggccccaagggtgccaatcacactcatggggaaaggtatggtgagttatgtcaaggtggcctgcatagggctctgcacgcctcaatctgtggggagtctctctctacattgacctactggatgagcttatccatttccatagctttagtcatcatctttaggggggtgatctaaaaatgtccatcttcaggacttaatttgctgctcagctctaggcctgccttccaattgtccactagacatcatcttcccaaactagagttcctcaagaattcccacttctatcaagaacaccacaatatttccagttgacttcatagacatatacttgattcctgtccttctctatttcttcacctctaatctgtcaccaagccctgatggttttgcttttaaatatctgtatttgcctattcctcatttccactgtcactttcgtagttcatggtagaatttcacttaacccatggtactagaaacatttctttgtaagatgccccgcttcatctctagcctgcatccattcattctccttacaaaaagcagtctactttcaacaccataaatccacatcaaacagtccatatatatttgttgaaatgagatgaattaaattgcattacaaaatattcctatatgacagacagtttccttatttggaacatgtgcatattaatgatttagggatgctatgaatgctagagaataaacacgatttcaaggtattttgcaagcataatgtcccaggactttgaaataaaaatacatttctatctactatattcacattctatgaaaccatcagaatttttgcagtatgatgtgcttcataataccagcttattaacattgtgtgttcatatctatggtgctgccttttggaaactgagcaaaattctcagagtaaggtactcacagtgagatgggtcatactactggcccatctagggcaataaggaggcaatcactaaattaagctctgatgaatgtgagaggttaacttatttctccaacctaatccatttattttcagctccactaacttactaaaggatcaaacggaatatatttaactatatgatcaaaatataaggatgattcactgacttttctaggttggtagtacagcaattgatttgctggtacaaccctgcagacaccatcttgtacagctacactgcgtgaaacagtgccaggcaagccaccctgcattttcactgaatgaatgcaggccttctttgctgcccttgttgccgcccatttgactcctgtcccaagtcagacaatcttgaattcatgcattctcctgaaaagtgcacatggcccttggcttcttctccattcctatatgtctcctcctctttcacaaagatccagccacatgaaccttctgtggagttcttaaaccaacaatcagcttcttctttcctgtctctgggc

SEQ ID NO: 388259 - DNA, 251 bp, Homo sapiens
tggtatctctactattccattaagagaatttccctgcactctccacaaacactgaagagtgagatttctccttcctaaaagtttgcattttcttcctaagaacactagctgagagggatggatgtacctaaaatgtagagctgattgaaatgtaggcagtatgcacagcctctgggaaccacgcaggctttatccaccaacatttgagtctgtggctgatgggaaaatgtgatagctgaaagtaaccaatg

SEQ ID NO: 388260 - DNA, 340 bp, Homo sapiens
atgcaggaggtggaggttgcagtgagctgagatagcaccgtggcactttagcctgggtgacagtgagaccctgtctcaaaaaaaaagtcactcattggactttgtttttgtagacccttcccttttttcctttctatctattcaggcatacattttaatttaacatatgacagtcattgacagagaatgtgtaagatgagaatttgttcaccttgccgggcgcggtggctcacgcctgtaatcccagcactttgggaggccgaggcgggaggatcacgaggtcaggagatcgagaccatcctggctaacacggtgaaaccccgtctctactaaaactaca

SEQ ID NO: 388261 - DNA, 662 bp, Homo sapiens
actccgtctcaaaaaaaaaaaaaaaaaaaaaaaaaaaaaatgaattgacctgtgacacctgtagcctaataaacatattaagaaaagtacttagtattgtatagatatttggattccaagagaaaatgcaacatttataataagaagtccatactctttttcttacagcagagcgtcacactgagttccattttaaaaaaggactcatttttcaggccaacaactgttgcatttgaatcagatataaataatagattttccacaaacactcagctgattgtagcagtgttatttaagctggtatgtttattttttttttcttggaaggatagctttatattttggctttcattataaattgtgttctgcttgtgtttaaatggcttacttataagctagagcactatatgggagtgttcttctctgtatggtatccttttatttgcttggctgggttcataacagtgtgtgccatattctttcttttcactgattctaagccatgagacttattagcatctggtggcaagctgcagggaccattaacagtgtgtctctttgactacaacgtggatctgccactacgcgctatgtaccattatgtacaatctctatttggctcaacttcgatgaaaaagaaataaatatttgctaaactctca

SEQ ID NO: 388262 - DNA, 419 bp, Homo sapiens
acctgtgcgcatttaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacatttacctaaattattgtggcactata

SEQ ID NO: 388263 - DNA, 196 bp, Homo sapiens
actgcactccagcctggcgagcgagactttgtctaaaaaaaaaaatcaactctgaaatttttccagtacaagtgtctgcgatttcaccccctttaatattttaggaaaactcatctcacttgcttgctttatttgcctgtgctgttggttccacgcactcatcagctcctccaggggaagccctggttccccacat

SEQ ID NO: 388264 - DNA, 306 bp, Homo sapiens
ttttgtgttttaattctatatcctgctacttttctgaattcatttactggttctaacaagtttttttgtgtgtgtgtgtgtatgtgtgtgtacagcattgttagggttttttaacacataaaatcatatcatctgtaaacagagataattttacttctccctttccaatgtgtatgccttcctttccaatttgtatttatttttcttgcctaattgttctagctagaactttcagtactatgttaaatagtagtggtgaaagcaggcatccttgccttactcctgatcttagggaaaaaacttgtg

SEQ ID NO: 388265 - DNA, 757 bp, Homo sapiens
tccatgcttccccatgtaagatgtgcctttcaccttctgccatgattatgaggcctcccgagccacgtggaactggtcttcattactccagccaaaaaaatagtaatgaaaatggaaacacttcaaggtttctttgaagactagaaataagttggtgaaggatatggcatataacagagctggaacacccttcttctcctgcctttggacatcagaacttcagattctctggccttcagacttcaagacttgcactagtggccccctgggttctcaaggttttggccgcctcggttgagagttacaccatcggcttctttggttctgaggccgttggagttggactgagccatgctaccagcttccctgggtctccagcctgcagattgcctactgtgagatttagcctccataatcacgtaacagaatattggcatgtagcactcctcaaaacatagaaagcagaaacaaatcaattctgcctggaggacctccccgatctcaacacccagtggttttgacagaattgatatagaaatagaagcttcaagcaaccttacgatggaggcagaagaaggattctatggttggaaacctgccagactcacaggctacggagaagaaaggctaaatccaccagactgttggatgcacctaaaacaaattgccctccgtggcttggtttcttattaatatactcatagaaatgcacaagaactgaaagctcgatagggaaaccaaaaaataaaaattaaaa

SEQ ID NO: 388266 - DNA, 400 bp, Homo sapiens
gagattgcttcctgtctagcctcaaggctctgtcctctgaaagccacgcttgggatcttcaggtaacagaatattggcatgtagcactcctcaaaacatagaaagcagaaacaaatcaattctgcctggaggacctccccgatctcaacacccagtggttttgacagaattgatatagaaatagaagcttcaagcaaccttacgatggaggcagaagaaggattctatggttggaaacctgccagactcacaggctacggagaagaaaggctaaatccaccagactgttggatgcacctaaaacaaattgccctccgtggcttggtttcttattaatatactcatagaaatgcacaagaactgaaagctcgatagggaaaccaaaaaataaaaattaaaa

SEQ ID NO: 388267 - DNA, 967 bp, Homo sapiens
catgggggcagacttccccctgctgttcttatgacagtgagtgagttctcatgagatctcattgttcaaaagtgtgtagcacttcccccttcactctctctctcctgctctgccatgtaaagatgtgcctgcttcccctttcattccaccaggattctaagtttcctgaggcctccctagccatgcatcctatacagcctttggaactgtgagtcaattaaacctcttttcttcataaattacccagtctcaggtagttcttaatagcaatgcaagaatgcctaatacagctttcaagtattatttttaaaaagaggcaccacctttactctggcttggctgaagtgatacgtgtcaccagcacagaagaaacagagctgagggatgagctggaacacccttcttctcctgcctttggacatcagaacttcagattctctggccttcagacttcaagacttgcactagtggccccctgggttctcaaggttttggccgcctcggttgagagttacaccatcggcttctttggttctgaggccgttggagttggactgagccatgctaccagcttccctgggtctccagcctgcagattgcctactgtgagatttagcctccataatcacgtaacagaatattggcatgtagcactcctcaaaacatagaaagcagaaacaaatcaattctgcctggaggacctccccgatctcaacacccagtggttttgacagaattgatatagaaatagaagcttcaagcaaccttacgatggaggcagaagaaggattctatggttggaaacctgccagactcacaggctacggagaagaaaggctaaatccaccagactgttggatgcacctaaaacaaattgccctccgtggcttggtttcttattaatatactcatagaaatgcacaagaactgaaagctcgatagggaaaccaaaaaataaaaattaaaa

SEQ ID NO: 388268 - DNA, 810 bp, Homo sapiens
ataatttgaatcgattctactcctgagactagtgtttataaataaaaagcgctttactggtatctccctgcccacaatgctcaactccaggatttccctggctcacctgcctgccatgaccaacaaggaagcagcctttgacaacgcagtggaagaacatgtgatcaaggaggagtacaaaatatggaaaaataacacctcttttccttatgatttggtgatgactcaggctctggagtggcccagcctaactgcacagtggcttccagatgtaaccagaccagaagggaaagatttcagcagtcatcgacttgtcccgggtacacacacatcagttgaacaaaaccaccttgtgcagcttcctagtgatgatgctcagcttgacgcatcacactacaacagcaagaaaggagaatgtggaggttgaggttcggttagtggaaaaattgaaagagaaatcaacaccaagctgaagaagtaaacagggcctgatatattacccaacacccttgtagcatcacaacaaagactccatccagtgatgtttttgtctttgactatacaaaacatccttctaaaccagaccctctgaagagtgcattccagatttgcatctctgtggacatcagaaggcaggctgtgggcttttaaggaacccaaatctcagtggacacttacttattacttcagataaccataccatctgcctatgggacatcagtgctgtttcaaatgaagaaaaagtgttgaatgtaaagaccatctttacagggcatacagcagtatttggagatagagatgcttccagtc

SEQ ID NO: 388269 - DNA, 379 bp, Homo sapiens
ttcttacatcaaatgcagtatatcatatcctctgttctataccttataattttacttaacatgtatctaaattaaaaaaaatttttttatttttagtagaggtgaggttttgccatgttgcccaggctggtctcgaactcctgggctcaagcaatccacccaccttggcttcctgcagtgttgggattacaggcgtgagccaccacacctgggcaaattttctaagtaaacatttatttggtagaagaaatatatcaagttaattatcccctacatttaaaaattctagaaaaaatcatattgtattacaggtgtagcccttcttctttgataaatagtaaagttattttgtatgctttatgttaaaattgtcttttaa

SEQ ID NO: 388270 - DNA, 592 bp, Homo sapiens
agcttaaaaaattgcaacaaaaatttcatatttttagaaagtttacacatttgtgttgggcctcattcaaagctgtcctgggccatgggttggacaagcctgatttaaggagtacattgaagcctaattaaaatgcttttcaccattgagtaaaactttatgatcaggtttgtcaggaacctcatccaaggtagtttagttagtggagtatcaaaagcaccttgttgtcagacactctcactaggacagtggtcccccagcagaggccaacaagcagttatacccaaacttcagcaaaatcaaaataagtagatttggtctaaagtccacaagcagtaaaaaccgttaccttgaaattttctgtaggtgcaaattattcttcagaattaaaggcttgattttcctaagctgtaattctgtttgagtcacttgtgaaaaatgctattttggtaaaagaacaactatgtattctttcaaaggagttttttccctttgtgttaatgcatttgcgtttatttggaattgcaggagatgatgaatgaagtacttgggaagtttaattcagaaatcattttgctttgcttatgtagaa

SEQ ID NO: 388271 - DNA, 955 bp, Homo sapiens
gagaacttcccatcttcccagtaagtcctaccggacagtacagagctgtgggtgtgtctgctttcccttcctgatttccatggccctggccagagtccctaccaacctctgggtttcctgtgcagttatcagtccagccaactcacctgcagagtgtaaagggtctggtgtacctacatttcacaaagcatcaggaatttgaagcatttctaggaatctaggaatatctagaaatcctaaatggaaatacaaccacacacatacacatatcaggcatgtatggtaatggttcaggctgggctgctttatggcttcctctgccataacagatgcagggaatggcctccctgcctcctggggtggggtaaggtgctaagcggaccagggctttgacattaggaagatttgagtttgaatcctggctttgtgaccttgatctcataacttaaactgttagcttcagaattctcttgtttaaaatggggatagtgataggaacacctccagtttttgttaagggcaaaatgataatctcatcagcacactacaagcacccaatatccacggatgtggttcccttttcctagattccctgctgaactccaaattggcagagaggaatattgcctaagtaatggtctcagtacctcagcagtactggaaggaattgccaattagagggaagctattagccagctatccacttcatgtgacccatggcaggattaataagccagtaaagcagggttgctcttcctgtgaattccttaacacttttcatgaggtttactgcctgctggacaatgtatgtattataatctattcctaaaacttgaggaatagttcaataattagcagttaaccactttggatccacacaagctcagcactcggtaatttactgtttctacaaccataggagaaagagtaggaagtaagtcattaaggcagtgat

SEQ ID NO: 388272 - DNA, 491 bp, Homo sapiens
gcccgggatgcatctcagtggaaaagcgcagagagtcaaagacctcagtgtcgggccatacagcactgttcctatggggggcatgatatgcatagagatcaggcttcctgtgggcagaacagaggtggtggcgggtgaggtgggggcacccctcccaggggagcctgtggagagttatgcccagtggggtggtgaaagccccagagagtagaaaggaaaatgccacccaggagaggacaacctggctggggtggggagcacctcgagacatctatctctacttggagggaaaggggaagccacagaggcagcagtgacagtatacgctgaggtggaaggaccactcagggtcagtgcctccaagtcctggcagccacttggccttgcgtgggaacttgcggtttaatcttccgtgaacttccatggttgatacccactgctaccagccagtgcacgcctcagagggcacccaaagctgtgcgtttgagtgc

SEQ ID NO: 388273 - DNA, 368 bp, Homo sapiens
  misc_feature (368)..(368): n is a, c, g, or t
tttccagatattatggaatatgaaaacacacaaaatgtctatacagtcaagataacctgtggaaaaataatgaagacagtggaggaaaggcaaaatggtaaagaagagaagagagagaaacaaaataatcattttccagcctacctaaaataataacctggactttcataaaactggcatatcttctgttttacatggaaaattattttatcttaagtttccatttagttgattaaaaatagggttatgaatgttaaataagtgatgatttattgcaaaggaaatatgtttcgaaaggtcgaataatgtctgtaacaataaaaggctggcctcgttggcctcagcggtggagcttgtcgggccggaan

SEQ ID NO: 388274 - DNA, 413 bp, Homo sapiens
  misc_feature (40)..(40): n is a, c, g, or t
  misc_feature (413)..(413): n is a, c, g, or t
aagaaatggatataaataaagagatatacagacaggcaangaaagcctttagagttaactgaaatggaacttttccagatgaaacatacagtcaagataacctgtggaaaaataatgaagacagtggaggaaaggcaaaatggtaaagaagagaagagagagaaacaaaataatcattttccagcctacctaaaataataacctggactttcataaaactggcatatcttctgttttacatggaaaattattttatcttaagtttccatttagttgattaaaaatagggttatgaatgttaaataagtgatgatttattgcaaaggaaatatgtttcgaaaggtcgaataatgtctgtaacaataaaaggctggcctcgttggcctcagcggtggagcttgtcgggccggaan

SEQ ID NO: 388275 - DNA, 651 bp, Homo sapiens
ggccgagcttctgagctggtgcctgtggatgctcgacggtcccgcagctcccacaatgggatggccaagcagaccctgagatccacagcccccctttagtgaaacaggagggaggtcgctgggcacagggagccgggaacgcctgccctccccgccatcgacggctcccgaggcctgaaccttcgctccagccccagcacaagccggccagggcgcagggccaagtgttgcccgccattccccgggtaccccatgacctcccagctggggctggctcggactgaggagtcgtccctgcccgtcaccctctggggtctccagtgctgcggagctcagctggcttttgcagcgatttgggggagtctctcccgcgggatgagggggggctctccgccgcacccgcactatgatggcccagagacccgagcttgggtcactcccgtcgccctcggggctcggcgagggtgcaggaggcgggcgctgagccggtgacgcgactccgggcggctcccagggtgcgccgcatatatagcagcggcggcggtggcggcggccacaccgggcggcggacacgtggagggacccggcccgcgccttctgcccctgctgccggccgcgccatgcggtgagcgccccaggccgcagagccac

SEQ ID NO: 388276 - DNA, 450 bp, Homo sapiens
ccccacatatactgagggacaactgtatttacatagcacttaattgtattatgtattataaacagtttagaggtgatttaaagtatacaggaggatgtgtgtaggttgtatgcaattactatataattttatatcagagacttgagcatctggggattttggtattctagagaggtcctagaaccaatccccttcaaataccaagagacagctatattttcacaaatcccaggaacccagtggcctcttgcagtgacggccaaaggttagataatatcctgtgtttggaggtactacctgcctaaagcagcaactctttcctgcaggcctgaggtccttgggggaatatctgggtagtgagcttcccagcatctgcctgggagaaggatggatggaacgtttgtttctctagcaatgcttaaatcctctcttctaccttacaaaaaaaaa

SEQ ID NO: 388277 - DNA, 213 bp, Homo sapiens
caaggcatattattaaatatctagtgtttataaaagagggtgaatccctaaaggtatgaagctagcaaacatatcctaagccatacctcctctactaagagaatagtggttctcttagcacaaccagtggttgtgccagccaagcgcatattaacactcagtttcaaattcatccttctatactctgctctgtgctcgggagctggtactctg

SEQ ID NO: 388278 - DNA, 281 bp, Homo sapiens
tcacagctgagagtttagacctaaaaggggcaataaaattgagttcaaatactgtattaagggacttgcccaaaattacataattattttgtgtaaagtccaaattatacaaatcctcagattccgaggtcggggtttcttttcctgtaacatgttccttcaaatatggctgtatccatgtttcatatcaagcagatccgagaaaaattatgaataatcagatagcataatgtggacacagggtcacgagcaataaagggttcttatagagctattaggaa

SEQ ID NO: 388279 - DNA, 347 bp, Homo sapiens
ttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaattttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatacttttt

SEQ ID NO: 388280 - DNA, 433 bp, Homo sapiens
agacccttagtattacttttacttccctctctgtccattcagaattgtctgtagctcttcctgggagctctgaaaacaactctttccatttctttctgaatgccccctctgcggggctatgatctagtccgtggcttgggtggagggacagatgtcatcctgtcctcttagttttcctttcccatatcaccagatttctttcttctttccgtagctaaagcagaagcatataggttttcatcagactcatttagaccctgaatctgatgtagggttagtcagagcctgtgaggtacacacacgatctaggaatctccctcacacacacacacacagaggcacacatacccaggacacccaagatacacacaccccagaatttctgaggtacatatacacccttcctcaagatcctaatttactaattgatagt

SEQ ID NO: 388281 - DNA, 170 bp, Homo sapiens
gcttggctaccttcgggcttgaactgaaatgctggctcttcctaggtttgaagcctgaccagcctttgaatgggaactccaccctcagctctcctgggtctccagcctgccgactcaccctgcagatcttgggacttgcccgcctccataattacacaagccaattcctt

SEQ ID NO: 388282 - DNA, 374 bp, Homo sapiens
gaatgcttattccccacctcaatctcacagctttactacatttcctaattttttatacttacaaagagagatggttctcaaatgatactgcttagttaacatctcaagattctgtccagattttgaaacagcaccaccaactccagaaacaacaatctggaatacaggtttacgtctgggatcctgggagtcttttaaccaactctccctacctactatctccctgcttggtagtagatttttttcttgatgaccccagtgccttaactgtggctgtggaccctaagcagctcagaatctccattccttcttctgacttaagtgcaacttcaagctgtgtcgtctactgccttccatggacgtttataagtgtg

SEQ ID NO: 388283 - DNA, 415 bp, Homo sapiens
gtggaaacatgatggtgaccatgtcctctgagtcatgtctctcagtttcatggtggcatgcagtcattaaaacagagcttcagaatttgtgctgtggttcgtaaaaaaactcagagtatgtatgttggggggacatggggatgctctttgggatacctgtctctgtgtgccacctgtctttgaaagcgaggaggggtggggagagagagagagagaggagagtttatgtctttcttaatctggttcttgaaaaaaaattccactagattgaaaatctgttgcttttagatgtgtcttttctccatcttggatttgaattcaaatttcatttcatttcacattctttaagttggaaccattcatgttaacatgcaaatttatgcaagcatcaaaacagaagaatgtggtgttttcg

SEQ ID NO: 388284 - DNA, 302 bp, Homo sapiens
aattacggacctaggggctccagcagtttccaggctcccctcggcggggctgaatgatcaaaactggtggtgagaatttttccgggccgtttctaggcagccctccccctccaccagctcggacccccccctccctcctttctccttctcctcccttttccttctcccctcccccagcgtctgggctgagtgatcaaaatagaggaagatggttgtcgccgcaatccagggctttgcaaggcgcggtttaatgggccgcctgtcagcttcctgctcgcaggaggaggtgacaagccaagcga

SEQ ID NO: 388285 - DNA, 207 bp, Homo sapiens
gggagctgccaagaccccaggcagcctcagtctgtggggtgcggcctgtggggtgcgaggagaggggcacaggctgggagctccggtcagtcctggccctcctaaagggcttgagttcagctgccttatcagggaaccaagccaaaccagcacagacctaaggatcaccccatggatggaagcccacccttctctctccactctaca

SEQ ID NO: 388286 - DNA, 498 bp, Homo sapiens
taaaaaagacagagtattgctctgtcgcccaggctgaagcacaatggcacagacttggctcactgcaagctccgccttccaggttcaagtgattctgctgcctcagcctcccgagtagctgggactacaggcgcaagccaccatgcacagctactttttgtgtttttagtagagacggggtttcaccatgttggccaggctggtctcgaactcctgagctcatgatctgcccaccttggcctcccaaagtgctgggattacaggtgtgagctactgcacctggccagaaaccattctaaaaaacaaaacaaattccaattttcctttagtatttaacatgccatttcaatcctaagtaactattcttatatctccttgaaatttttgtactaaaaataaattttgtcctattagttaaaaaaaccaacagcaatcttcaaatgtcaatgattaagggtttttgggttacacaaacagtttgaaccactgagttcaata

SEQ ID NO: 388287 - DNA, 367 bp, Homo sapiens
gattctcttcccgcaggtgtcccgtttctcctcccctagtgtccttaagtcctcctccacaggaacatctattgtggcttgattctcttcccgaggatgtccctttctcctcccctagtgtccttaagtcctcctccacagggaacatctatttgagcttcgattcacttcccaggtgtccctttctcctcccctagtgtccttaagtcctcctccacagggaacatctatttgggcttgtgtccctttctcctcccctagtgtccttaagtcctcctccacagggaacatctatttgggctttgatgtttaataaagtagaatctcttcccaggtgtccctttctcctcccctgtgatagagtact

SEQ ID NO: 388288 - DNA, 1041 bp, Homo sapiens
  misc_feature (266)..(266): n is a, c, g, or t
atccgggacttcagggtcagtacattacaatgcctgacaaatcctagccagttctatcaaattatatctttcttacaggcttttaagctattagtctcataaagatacatttaatcagcgaggtaatggcatgatgagtgtttttaggttaaaaagagaacaggaactgttgccagcagaatggcgatattcaagacaacacgcacaagaagaggcgggtcctacgcgcttcgctagggaagcccgggtcagctcgctgcgcaggngcagtgagttcgacacaccatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatgggggtcatcccaataaaggataccgaacatttttgatgcgg

SEQ ID NO: 388289 - DNA, 3143 bp, Homo sapiens
  misc_feature (3)..(3): n is a, c, g, or t
  misc_feature (2958)..(2958): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388290 - DNA, 2191 bp, Homo sapiens
  misc_feature (3)..(3): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtggcttcttcaagacctttaagaaacaaccacatttgggaaaccggattaacttccctggcattaaacagggaacccccattttctttttccttt

SEQ ID NO: 388291 - DNA, 3077 bp, Homo sapiens
  misc_feature (2892)..(2892): n is a, c, g, or t
agcaggctggtacgccccggcgtttggcatgccgactgtcagcgtgaagcgtgatctgctcttccaagccctgggccgcacctacaacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388292 - DNA, 3042 bp, Homo sapiens
  misc_feature (2857)..(2857): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388293 - DNA, 3030 bp, Homo sapiens
  misc_feature (2845)..(2845): n is a, c, g, or t
ataagcagccctggaagacatccgggtactatcaggagcacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388294 - DNA, 3063 bp, Homo sapiens
  misc_feature (2878)..(2878): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388295 - DNA, 2687 bp, Homo sapiens
  misc_feature (1)..(1): n is a, c, g, or t
  misc_feature (2502)..(2502): n is a, c, g, or t
nctaagcggaatgactctataactaccacggctaccagaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388296 - DNA, 1971 bp, Homo sapiens
  misc_feature (3)..(3): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaatgcggccactcacacatataaagaaataaagaaccagacccacacc

SEQ ID NO: 388297 - DNA, 2600 bp, Homo sapiens
  misc_feature (3)..(3): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaaaaaaaaaaaaaaaaaaaaaaaaaaaaaaaaaaaaaaaaaaaaaaggggggggcccccaaaaattccccccgagagggggccccaaagttgtaaccgcgcgtgatcccacgaggtttttgtgtggagaacaaggggggcgcccaaaagaggaggaggcggcgtatttaaaagcacgaaggacgcaagggggccgggggtaaaacaacaccgggaggagacgggagagaaacacggcgaagcgggggagaacctgggaggaagagagaacccataagcacggggggcggggagacaccaaaggggcgccaccaatcccccaacagagaaatttaagagccccagaggggcacattataacaccttaaagggggacaaccggtggctaacacaatggggggaaatattgtgggaggcgatggtaaaaaaattgtggctaaacagagagggattatcttttgggagaaaaattttttgccggggagctgtgtttataaatatgaagaaagtacaaaacaaaaaaaaaaaaagacaaaaaagagaaaaaaaagaaagagaaaacatggggacaaaagacgtaaccgaaaaaaggcaaaaaaacgactggtagagaggaaaaggaggacacagaagaagaaaccaaaaaaaaaacacaacaaccaacacgagacaaccac

SEQ ID NO: 388298 - DNA, 3366 bp, Homo sapiens
  misc_feature (3181)..(3181): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcaggtatgctctgaaaacttcacttaattcaagaacaaagtacacgtatgactaattttttttttgcgatccttcagagtctgttaaggaatgataaaacatcagttaagatatctggtttctgatagaactcaaaaagaaaagttactgtttcagctagtagcatatgttgaaacacaatgtaacattaaaaaaataatccaatgaagtttatggtttgttcattcctttttcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388299 - DNA, 1930 bp, Homo sapiens
  misc_feature (3)..(3): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccagcacaccctatagtgtcatttttttatcgtaacccaattgtctgaaatgctttgaaaatggtttcttaatattaaaaggcatatgcatgt

SEQ ID NO: 388300 - DNA, 3091 bp, Homo sapiens
  misc_feature (3)..(3): n is a, c, g, or t
  misc_feature (2906)..(2906): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388301 - DNA, 2589 bp, Homo sapiens
  misc_feature (33)..(33): n is a, c, g, or t
  misc_feature (2404)..(2404): n is a, c, g, or t
tggaaggggaagaggaagaagggaaggaggtanctgcaaagactctcttaagaaaagagcactggttgccattggtacccatgatttggacactttgtcgggcccatttacttatactgcaaagcgtccttcagatatcaaataccaaggagtatacagcctgtgaactgatgaacatatacaagactgacaatcacctgaaacattatttacatatcattgacagttatctatgatagcaatggtgtcgtcctttcaatgcctcccatcatcaatgggatcattccagaataacagtaaatactaagcacggaaactgactttactaaggcaaaaatagttcttgatattattgtcaccatgttcagtgaatattgtgagaatcaatttacgtcgacctaatgaaaatcacatacctttccagaattagcttaccgaaaggagatggtgacagctgacctaattaacaaaaaaagtggaatgagagaaacttctgaccgaggatgttttaaaatcaaaagtcttaggggatgggaaataaattgagattaaatccctccccccgggtaccttaccacgcatgtcattgtagaaacgcaggtattggtctggatatacccaattagagggatttcccgaaaccttcccccaaggtaacaatttccttttaatagcccatgtaattttctgacatacaaggcaccgccgggttcacttaagcacttccctttgccttgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388302 - DNA, 1438 bp, Homo sapiens
  misc_feature (3)..(3): n is a, c, g, or t
tgnacaaaaagcaggcgggacgcggtcggaattccggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagctcgcccctgagttagcagctcgttcctgagttagcagctcgcccctgagttagcagcgcgcccctgagtttcagctcgcccctcagttacagctcgcccctgagttgcaggctcgcccctgagttcctgctcgcccctgagatcacgctcgcccctgagttcgagctcgctggtcagttgttg

SEQ ID NO: 388303 - DNA, 784 bp, Homo sapiens
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatgggggtcatcccaataaaggataccgaacatttttgatgcgg

SEQ ID NO: 388304 - DNA, 1600 bp, Homo sapiens
  misc_feature (17)..(17): n is a, c, g, or t
  misc_feature (65)..(65): n is a, c, g, or t
  misc_feature (1415)..(1415): n is a, c, g, or t
gagggagaaggcaaaanagcagactttgtaaacttatgacatcacatttgtcttgaattactganatatgtgttcttcattgcaccttgcacataccaccatttatatatgacggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388305 - DNA, 1417 bp, Homo sapiens
  misc_feature (54)..(54): n is a, c, g, or t
  misc_feature (1232)..(1232): n is a, c, g, or t
atggacaatggattaccgaatttcgagctttcggtacccacgctccacctcggncaaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388306 - DNA, 1535 bp, Homo sapiens
  misc_feature (1350)..(1350): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388307 - DNA, 638 bp, Homo sapiens
tgatgttgttctttacaaaattgacgtccctgccaatagatatgatctcctgtgtctggaaggattggttcgaggacttcaggtcttcaaagaaaggtaaggaaatatgttccttaaagactttgctaagttgggttttcttttctttccttgtcattatcagcagccatgtttaaatttctaggaaaaagcttgtagaggaacgtagctttagctctcaatagagggttgatttgaggaattagattcatgcagattgtagccatttgaaaatttccatgaaaattttagtcatagccattcatctttgagaacatattttaaaactggtgtttaatgcttttatggcgtcttaaaaaattatttagcaggtgtgtgtgattcccctccgtgatctaattggaatgagtagttcactggatgtgttaaaagttgagaggaaatggagagctagcaataaatacccttacattatgagttctaaggaagctcaggagtgaagcctcctaactggaaaaaccaaagatcttatgacggctctgtgatcttgagcaagttagttggcctctctagtttcaatttcctaatctataatgaagaagatttataaggccccttccagcttttcatttaatgaa

SEQ ID NO: 388308 - DNA, 652 bp, Homo sapiens
ttttaacctaggaatgaaaaagaacaaagcctttgctttccataaataattttggataataatatccaatgcatgtttaaaacacatttgagatataattgtttaaattgtggaacattaatgaaattttaaaagattttaaacttttcagaggggttgtttggtaaatatatgaattatgagcaaactttttctcaattatttaatacattttcagaaatcttactgaaatataaattctgtgaaggtagtgactttttctcttgtttaccactttattacttgttgactgaataaattaatatatacttgtttgaatgaaaatgtatgccagtggcaagaatgcagctaccttcctattacaagatattacaaagaaaagccttactgtttgctatctctaatgatattatgaatttcagacagctaagatacgtccttttgcggtagcagcagttctccgtaatataaagtttactaaagatcgatatgacagcttcattgaacttcaggagaaattacatcagaatatttgcaggtttgtggttgcattttctttcttccttgccttcccctttccctttgtctccctatctcctttccatcctgatccctctccctcttctctcttgccacttctgccttctttctc

SEQ ID NO: 388309 - DNA, 3133 bp, Homo sapiens
  misc_feature (2948)..(2948): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388310 - DNA, 3658 bp, Homo sapiens
  misc_feature (3473)..(3473): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattgctccgtagaatttgtgacagccctggctgacctccgagcagaggctagctgtcccatctgtctggactacttgaaagacccagtgaccatcagctgtgggcataacttctgtctctcctgcatcattatgtcctggaaggatctagatgatagtttcccctgccccttttgccacttgtgctgtccagaaaggaaatttataagcaatccccagctgggtagtttgactgaaattgctaagcaactccagctaagaagcaagaggaagaggcaggaagagaagcatgtgtgtaagaagcataatcaggttttgactttcttctctcagaaagacctagagcttttatgtccaaggtgcagtttgtccactgatcaccagcatcgctgtgtttggcccataaagaaggctgcctcctatcaggaaaaaactggagcaatacaatgcaccgtggaaggagagagtggaactaattgaaaaagtcataactatacaaaccagaaaatcactggaactgaagaaaaagacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388311 - DNA, 3179 bp, Homo sapiens
  misc_feature (2994)..(2994): n is a, c, g, or t
gtgcaatgagttcgacggagcatgccgactgtcagtgtgaaacgtgatctagttcttgccaagcccactggagactgccatgctacatctgcatcgatggcaagtttgtatgtaactatgtttatagaacgttctgcggtcgtggcagactgtgaaatcgaaactgtacactactgtagcagagaggaacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388312 - DNA, 3112 bp, Homo sapiens
  misc_feature (2927)..(2927): n is a, c, g, or t
agcaggctggtacgccccggcgtttggcatgccgactgtcagcgtgaagcgtgatctgctcttccaagccctgggccgcacctacatatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388313 - DNA, 2703 bp, Homo sapiens
  misc_feature (2518)..(2518): n is a, c, g, or t
gtgagcatatcccggtgttagaggtatcaatgattagactgagaagaaacctggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388314 - DNA, 2724 bp, Homo sapiens
  misc_feature (2539)..(2539): n is a, c, g, or t
tttcgttcacgctgtatttccaaaggttttgtctctttaataacatgttaaattttaacttattaaagagcttagaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388315 - DNA, 2358 bp, Homo sapiens
  misc_feature (24)..(24): n is a, c, g, or t
  misc_feature (32)..(32): n is a, c, g, or t
  misc_feature (2173)..(2173): n is a, c, g, or t
ctcgtttgtaactgactctcttanctaccagngctaacggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388316 - DNA, 3073 bp, Homo sapiens
  misc_feature (2888)..(2888): n is a, c, g, or t
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacgtcgacctaatgaaaatcacatacctttccagaattagcttaccgaaaggagatggtgacagctgacctaattaacaaaaaaagtggaatgagagaaacttctgaccgaggatgttttaaaatcaaaagtcttaggggatgggaaataaattgagattaaatccctccccccgggtaccttaccacgcatgtcattgtagaaacgcaggtattggtctggatatacccaattagagggatttcccgaaaccttcccccaaggtaacaatttccttttaatagcccatgtaattttctgacatacaaggcaccgccgggttcacttaagcacttccctttgccttgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccaatgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatgntgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 388317 - DNA, 1077 bp, Homo sapiens
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacgtcgaaagctgctgaaagtggtttttcctaagtggaaaatccacattaccgttccagaaataaggtttaccggacggcgaatgctgacaaggctggcttattaaaccaaaacggtggcatgcaggaaaccggaaaatttggccagctttgacccggaggttttacaaccaaagcactagggggggaacacacggcactgac

SEQ ID NO: 388318 - DNA, 1852 bp, Homo sapiens
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattgctccgtagaatttgtgacagccctggctgacctccgagcagaggctagctgtcccatctgtctggactacttgaaagacccagtgaccatcagctgtgggcataacttctgtctctcctgcatcattatgtcctggaaggatctagatgatagtttcccctgccccttttgccacttgtgctgtccagaaaggaaatttataagcaatccccagctgggtagtttgactgaaattgctaagcaactccagctaagaagcaagaggaagaggcaggaagagaagcatgtgtgtaagaagcataatcaggttttgactttcttctctcagaaagacctagagcttttatgtccaaggtgcagtttgtccactgatcaccagcatcgctgtgtttggcccataaagaaggctgcctcctatcaggaaaaaactggagcaatacaatgcaccgtggaaggagagagtggaactaattgaaaaagtcataactatacaaaccagaaaatcactggaactgaagaaaaaggtaaaacatacggcagaagaagtcaagtctgaatttgagcaacttaggttatttctgcaaaatgagcaagagactgtttttgggcaattacaagatgacgagatggatattttagcacaactaaatgaaagcctaacaaaattttcagattatacctcctcattaaaatatctactaaagaagatagagagcatatatgtgaagtcagaactggaattactggctgatgttaaggatatctatcacagacataagaatttaaaattccctaaaccttttttattcaaattaaaagaatatggttaccatctgtctccacaatattgtggccaaaacaaaattatcaagcgatttcaagtagatgtaattctagatcctgaagcagcacatcgtaaacttatagtctcagaagatagaaaaactgtgcgatatggaaatacaacacaaaacttacctcataacccaagaagattttatctgctcccagctgttctgggttctaagggataaaattgtggcaggcagtaccgggaagtagaagttaaagacatgcctgaatggattcttggtgtctgtagtgactctcctcccacaaggaggaagagtcaaccaattttagtacaggatggattatggagaatttggtaatctagtcggaataattatattgtattgggccataaggaaattattctgctgccaaaagtaacacctagtaagattggcatttttttagactgtgaaatgaatgaggtttccttttataatttgaatgatagatctcttctctgtacttttaatgatgattttacaggagaactttggccttatttttatactggaactgactcaaaacctcttaaaatttctacagtaacagattctgtattttctttcacctagtagacataactgagccagttaatctagttttggccattctgtattttgtccagtttttctcataaaaaaacaatattttttatctcaatttcagcaacttccaaaaaatgtgattatgggacctactttataataaattatggggtcaatgacaaagtactttagaaattctacggtaaaatacttgaaaaatatattactgaaggaacgtattatgtaagaaaatctattacttttgtaattgccaataaaagcccaatttttttctcaaaaaaaaaaaaa

SEQ ID NO: 388319 - DNA, 782 bp, Homo sapiens
agcaggctggtacgccccggcgtttggcatgccgactgtcagcgtgaagcgtgatctgctcttccaagccctgggccgcacctacactgacgaagaatttgatgaactatgttttgaatttggtctggagcttgatgaaattgtatgtattggatatttgtctatttttcaaagattgtgtgcataagcttatttttcagggttatactgtatttcatctttgttaccttatagttagactaaggtgataatgtttgtgggccatgatttctgtgttcagagggctaagctccatgtctgtctgttgccttgactaaaatctcaaaaggagttcatgccttattccatctacaatcaccttgttaccaggctcatgcctataataccagcacttgggaggctgaggtggatggattacctgaagttgggagttgagactagcctgaccaacatggagaaaccttctctctactaaaaatacacaaattaattggatgtggtgagtagctgggattacaggaaggagtccttatcttggacctgaggctgctttcttgaagaaaacttgactttatttcatttagtgggaagagcagcagcccagctaataagttctaatatgcaataggctgcaggctgtgaagtctgaagctaaggagctgagggcttaacaagtttctagaagctgccatcaacatgccaagtcagtaaaactgaaagctggtcagatttcaaggtctggggaggaatccactgcatagtgggtcttgagctctagagag

SEQ ID NO: 388320 - DNA, 343 bp, Homo sapiens
cctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatata

SEQ ID NO: 388321 - DNA, 406 bp, Homo sapiens
  misc_feature (178)..(178): n is a, c, g, or t
  misc_feature (188)..(188): n is a, c, g, or t
aatatacaagaactggaattaccagttgcaacacaaattgcaatttaaaacacacacacagagatcagcacagatgattcccaaggagacttcctacgcttcattgaaagaaaaaagcataaccccatgcaggacagtgaaatgaacagaagagacaggaaactgagtttttcctccngactagctcntatttgcatgacctcaagcaagtatcttaacctatatagaaacctttgtaaagacaggctatttccaaggacggtagcaaagacgaaatgacagaagaggtgtgaagggcctatggtttcagattgttactgttcatgcttcagaaaatgtcaccgtctccagcagctcacttcccaactttgatcagatgtagtcaagactggccaactaaagattt

SEQ ID NO: 388322 - DNA, 544 bp, Homo sapiens
ttagagtatcctaccctcctaccccacgccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagtccccacggtgtgctaagcgaggagtccgagtgtgtgagcttgagagccgcgcgctagagcgacccggcgagggatggcggccaccgggaccgcggccgc

SEQ ID NO: 388323 - DNA, 338 bp, Homo sapiens
ccccctcctgtggacattacacccctactgtttgcgccctccataccttgccttgcccaatgtgccctgggtcccatacccctccacatccccaggaataggaatttgcccatgggccccaaggttaattgccccctggatcccccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaacatacaagatggtagtcacagacagtaccg

SEQ ID NO: 388324 - DNA, 5039 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388325 - DNA, 5079 bp, Homo sapiens
ggaactctaaagccaggttggtacattattaaaagccatgggccctgacatcacacatgatgattataatgtgaagagacgagactgagactataaagaaagaccaggagtgagctaacttgaatgataccaaggaagatgatataatatgaagtatatcctcatctggtaaagacagacagaactctgaagtggaaagagcacttgtcaagatatcaggagatgacggctttgtgagttctgtcactaaccagtatcacccttgaaggcagacattgtcctctcaagttacagatgaagaaatggaggagcagaatgctcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388326 - DNA, 4313 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388327 - DNA, 3539 bp, Homo sapiens
cggtaccccctcctaccccacgggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388328 - DNA, 3051 bp, Homo sapiens
ggcgtctgaggatccccccaaggatgagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388329 - DNA, 1105 bp, Homo sapiens
ttagagtatcctaccctcctaccccacgccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388330 - DNA, 881 bp, Homo sapiens
  misc_feature (29)..(29): n is a, c, g, or t
gcggcagcgtgctccgggcgtctagaggnccccagacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388331 - DNA, 2288 bp, Homo sapiens
  misc_feature (2238)..(2238): n is a, c, g, or t
  misc_feature (2241)..(2241): n is a, c, g, or t
  misc_feature (2243)..(2244): n is a, c, g, or t
  misc_feature (2276)..(2278): n is a, c, g, or t
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtgtagtgaataaaagccgttctaaggaaaagaggcacttgcggccgcnagntnnttgcctgtagttacggctacattgttatgttnnntccgggattt

SEQ ID NO: 388332 - DNA, 946 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacccaaatgtgttggcggtgtggcgctcgctgggcccccccttccgggg

SEQ ID NO: 388333 - DNA, 4985 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggtaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388334 - DNA, 4958 bp, Homo sapiens
acgtcaccgctacatatgtagcttgctctcatcatctccaaactttttacatttgcttagctgacacagcttctcatccactctatctgcaataccagctcatcccattaccaataaatcttttctacatcctcaacctcatctcccaatattcttcccacctccttaccaagactctcttcgctctttgcatcttaactgcgatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctggtattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctaaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 388335 - DNA, 1363 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacatcagaggagagggaggaaaaaaaaaaaa

SEQ ID NO: 388336 - DNA, 423 bp, Homo sapiens
ctctgttgtagtacatcttcaaataattttttcaaggatacatgaatccttgcatatctgagaatgtctctttttaatacatgaatgttgaattgcctgggtgtaaaattctagaggtaacatttttttcttttaaaacactgtacagtggaatcattctgattcagttgcaaggttaaaaaattagcatagaaggcaaaaatcatgcatagaagttaaaatcactctgaatttaattccttaaaatgtccatcataccagggctgggcccttggaaactcaaaagcctaggatgatcttctatttttgcctttgactgaagttcccctttctctgaagcagagaaggccaaacatctgctagcaaagcaaaagtttgaaattggattcttgttaggcaaaacataaattattctatgtagtt

SEQ ID NO: 388337 - DNA, 398 bp, Homo sapiens
tccgttgccgaggctggagtgcagtagcttgatctcggctcactgcaacctccacctcccaggcacaagtgatcctcccacctcagcttctcgagtagctaagccacagacacgcaccaccacgcctggctaattttgtattttttgtagaaacggggttttatcatactgcccaggttggtcttgaactcctgagctcaagcgatcctcccaccttggcctccaaaagtgctgggattataggcatggtatacatgttcttaactgacatatatacatacatacatacttttgtcagcatattctgtttttgtgcatgcatgtggaaacatgtagccttaagttcaagaacaaatacaaaagagagaatgagttatctttaaatgagaaaaaaaaaa

SEQ ID NO: 388338 - DNA, 1048 bp, Homo sapiens
catataaactccatatccgattccccatatctaggttagaacgtctcttttctccctgtcaatcatgaggactaatgcagcacacaatgtatacagtactaataaaggctttggacttaccacttccttctttgaaatcccaactggtcgcatcttaggttggtttggggcagtcccttgtgggaactctcctgctattctgtctggttttgggccttactgcagttgtggttttgggtggttggaacaagcatatatttcaataaatacgttttttaaatgtccaaaaaacaacatgacacaactgcgggtcgagagccagttttagtttgtcccataagctttctgtctttgttcagtttagttacaatggagaaaacctctttaatgttgacaggatttctttagaaaaaaaccattgctatatctgaaagtccagtttcaactggcaaaattggacaaaagcagcaatttgaaaaaccaagctacttataacttgataaagtcctctataaactaagtcattatatttctccttttaaataaaccattgtaaatttaatgttcatatcagttgagtattagtttccagctggattcatgctgaataaagtccagaaactttctttgtgattcaaatagatgcacaggaagctgggaaggaaaagaaaagcatatggtgagtaaatttcttaatgccaggtattacattaacatgaaagcagccaacattcagcattcctattcatttggaactcaatgagaacgttgagttacttatcactgactacttaaggggacatttgcctatttatttacaatgctttgcagaagtatccagtaacatttatgaatttatttgtatatatcaaatattatcttatgttctaatgaattttatccatttcaggtagagaatggattattctgaaaactagattttcatataattttgtttttagtttcattttcatttttaaaatataagatttttgttattgctataaaatacatgatcattacaaaaaatctgaaaaacagtagggaa

SEQ ID NO: 388339 - DNA, 310 bp, Homo sapiens
gtcgaactctaccacttgcaagagtatcgttttcagtgtctcccacggagatagaaccatggaaagaaaaattagatgtaaagtaatagaaaacagtttaaataaacactgcatgaagaagccagatgtaagactctcctttaattctaactggcatctaagttggttaaaaatctcagccaaggccaggcgcggtggctcatgcctgtcatcccagcactttgggaggctgaggcaggtggatcgcttgaacctgggaggtggaggtcgcagtgccgcagagcacacgccctcgcacactacccaggga

SEQ ID NO: 388340 - DNA, 414 bp, Homo sapiens
taaacagcattattgcgatgcgctgcccctccccccaccaatctcatgtcaaattgtattccccaatgttggtagggcctggtgggaggtgattgcatcatggaggcagtttctcgtgaatggtttagcatcatccccctagtgcggttctcgtgatagacttctcacaagatcaggttgtttaaaagtgtgtagcacctctctcctctctctcttcctcctgccatgtaagacacctactcctgctttgccttccaatcaaacctctttcttttataaaaacctcaggctcgatatttcttttcttttctttttttttttttaaattctttttcaggtatttatagcagtacagtaatggacttataccatacacccgtttgaagtgtacaattcaatgacttttagtatatt

SEQ ID NO: 388341 - DNA, 438 bp, Homo sapiens
ttccagaccttctctatggagaattgaaaattcctaaagaaccccccacccccattcagtacacttccagattccaggaagaccagagaggagaaggctggtgtccacaccttagcacgtccacttggctttagactctcccacctggcagagacagagccatcttcctaggccctctgcccacaggaccttagagaaacaacatcaggacatcacagtgattcctgccttcagccctttatccccagagaagagctgcaaagtctcgcatgccccatctcattgttgcaactaggttttgttgttttttgtttgtttgtttctacagctggggccttgttgaccttagaggcactctcttcccagaattcctggagatggtaaaggactcctcacttaccagcaggcctttcatatgcaaaccagccactctgagcc

SEQ ID NO: 388342 - DNA, 390 bp, Homo sapiens
ctgcctgatgggagtgtctttgtttgccttggggctttggccactggacaatctaacgagatctatgaagggggttttgagccacattgtatcaggtctacctccagaagggctggtgactgaaggtcaaccatgcaggtggtatgtgatcaagcctcagtaaaaactctggacacaaggcttgcatgagtgtccctggctggcaatactctgaacttactgtcacatgccgatgctgagaaagaaacactgtcctgacttgatggaaggaggacacccggaagctctgcgtttgctgctttctgggaccccaccctatgcatttcttcccttggttgaagaagggacctgcatcccttccctgtaataaaccataaccttaagtacaaa

SEQ ID NO: 388343 - DNA, 309 bp, Homo sapiens
gctctttgccactgttgtctttaaaaggtataattgccctggtgacactgtgcaggcgtgcttgcacccaaagaaagagagagagcaccagatctgtctgtcttgcagcggggagccaggacacagctcagcttgcttgcgctcagagggaaagagttaagctgttgaccccaaagggagagagagccagcagagatctgtgcttgggagtggctggaacaagcagccgagacacacagtgtaagagagctgctgaataaaattgtatttcacctacccgtagccccctgagtgttctttcagctgtct

SEQ ID NO: 388344 - DNA, 6454 bp, Homo sapiens
  misc_feature (952)..(952): n is a, c, g, or t
  misc_feature (1987)..(1987): n is a, c, g, or t
cggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgcngctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctncctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctgaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgcccatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcgtccgagcccctccccggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggtgtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacacaaaaaaaac

SEQ ID NO: 388345 - DNA, 1113 bp, Homo sapiens
cggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggtaatacgtttataatgattgctgtatcttacagagaaggattctatactgagaacgatgtatatccatgctgatgatggaaaaaagaatactagtgataacccactgctaacatcataatgttggcatataccaacatgcttatcatggactaggcattgttttagacgcgttccatgtattatctcatttaatttggacaacaaccctattatcatctcctttttgcaaataacgtaattagtgagatagaacatttctacttctggtataaaggaaacaatcatctttattcagaatccaaaataaacacagatctcaagaaatagcctacaaccacaaaatca

SEQ ID NO: 388346 - DNA, 1133 bp, Homo sapiens
cggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttggagatggagtctcactttgctgcccaggctggtctcaaactgctggactcaagtgatcctgctgacttagcccccaaagtgttggattacggcgtgagccactgcacctggcttgccatatctgatgaagtctgttgcttcttcccaaaaagcagccagaaatctcaattacatcccactgttaagaaac

SEQ ID NO: 388347 - DNA, 911 bp, Homo sapiens
ggcagaaggagctgtacagagacgtgatgcggatgaactacgagctgttggcatccttgggtaaagacgcaccgagcctcttattcaccaccctcctttgacttgggaagcccacaaggggagctgtggcttgtggttatcttcccattcctgccccctccctgtgtgtaggcagagaccgatcctgtcttttgcacctcataactcccctgcttggggtaactgtgctttatcaccttctcatccacccacctgttcatccattcgtcccccaccaaacattttggagtacctactatgtgccagatgaacacagctgatccatggtctctgctttcaagggcctagcacgtttgtgggagagacagacattttaataagaaactataaaataatacagtctcccataaaagagcttccagaagagtacccggggctactgaagaagagggatttgatttcctgggcattggtgggaggaatcaggaagcctttatagagtaggaaatgttttaattgagttcaaaaccaggtggatcagaaggaggaagggcattgagccatgatggaggggacggcctggcagagccacccctatctgtgcagcccagggctaaggctcctgcatcctggccaggcgccggcaagggttggcagccttcagcacgggagtcatggggtttggaccttggcagattaggaagagggcagtgcttcttgctcctcaggatggtgctctcctctcctgcatctgctgttttatcttctctttgcctctttctggcagattagcaaggttcttatgaagcatcaagatggaaagacaactttttttgttggagacagtctcactctgtcgcccaagctggagtgcagtggcgtgatcttggttcactgcaacctctgcctcc

SEQ ID NO: 388348 - DNA, 6538 bp, Homo sapiens
  misc_feature (952)..(952): n is a, c, g, or t
  misc_feature (1987)..(1987): n is a, c, g, or t
cggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgcngctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctncctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctgaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgcccatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccccggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggtgtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacacaaaaaaaac

SEQ ID NO: 388349 - DNA, 297 bp, Homo sapiens
ggggtgtcttagctgatagaagatggcagagttctgggtagcagaaccaagcatgattcaattttctccaaagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagag

SEQ ID NO: 388350 - DNA, 1384 bp, Homo sapiens
agttttaaaaaatcttctctggcttcagagaagattttataaggacttttgtttgggataagctttccagattatccatgtctatttgcatcaaaggggaaagaaatggggcttttggatggctcttccagtgcattcggaacattgcctcttgcctttattcctgcattttatggcaaagccaaaagaaactcaagttgcaagaacaaaacccagtgactcgttttgatggttcaaaatggtttcctttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatcccagaaaagggaaaaataaagctgcagttaactttcttatgtgcatccttccaatagagtactgtatttttcaggtgttttgcatttaacataaaagtcctcgggaaacaggtgtcaaaaacagagagagaaatcctgggccatcacttcacaaatatcccaaacaagatattcttttcaaacagggctccctctcagtggtcatgagggaaggttgataatgttctttgttggggactgtttatacaattttttttcaactgtgagctttggaatcgtaacttgctgtgagtccagcttctgtctactgccataagatggaccccacgtcagcataatgagggtggtatatatgctcgcacctagacatgcgcatatgtacctgtcgtaccttcacggaaggaaaacaggctactgacgtttcggaggagtagccaccagtgcctaatatcttttgggggggatggatgcttataattgccagtatatcgaaaccacactgggagttccacata

SEQ ID NO: 388351 - DNA, 1163 bp, Homo sapiens
ggatcccctcacgcttatacttcacatttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatcccagaaaagggaaaaataaagctgcagttaactttcttatgtgcatccttccaatagagtactgtatttttcaggtgttttgcatttaacataaaagtcctcgggaaacaggtgtcaaaaacagagagagaaatcctgggccatcacttcacaaatatcccaaacaagatattcttttcaaacagggctccctctcagtggtcatgagggaaggttgataatgttctttgttggggactgtttatacaattttttttcaactgtgagctttggaatcgtaacttgctgtgagtccagcttctgtctactgccataagatggaccccacgtcagcataatgagggtggtatatatgctcgcacctagacatgcgcatatgtacctgtcgtaccttcacggaaggaaaacaggctactgacgtttcggaggagtagccaccagtgcctaatatcttttgggggggatggatgcttataattgccagtatatcgaaaccacactgggagttccacata

SEQ ID NO: 388352 - DNA, 531 bp, Homo sapiens
gatgtgcaaagagctggggcagtatgttccaggcagagtgaacggcataggcaaagaccctggaggtgggaaggggcaagacatgcttttagtaactcaaagaaggccacgtggctggggcttgtgatgagagagaatcaggcaaagtgagttcagagaagcataagggccagatcacaccaggctttgaagccgctgggaacttggattttattccaggtagtgagagatgcctctaaagaattttaggtgatagattaacgtacttttccctttttcacggatctgtcatgcattggagaatggactggcagggtgagattgagagcagggaggaagtgaggtggctactgtgtcatccaggtgggtagggacaggtcttgcctgcaggggcagcagtggtgttggagaggtgtgggtgggtgggttaggaagtggaaccagtaggctgataacctgagctatgccattaggaagagggcgagtggatggtggcaccatttactgcagtgggtcggggaagggagcagg

SEQ ID NO: 388353 - DNA, 405 bp, Homo sapiens
attgaagaattatacacatacacaaaaatacacaaatataaagtggatagcttaattaattctcacaaattaagcattcccatagaaacatcagcccctttaaccacccccaaggggtattctcctcacttctatcatcataaattagattgcctgtttttgaactttatgtaaatgaagtcatgagtgcatgcttttttcttcttcttttttattatactttaatttctagggtacatgtgcacaacgtgcaggtttgttacataggtatacgtgtgccatgctggtttgctgcacccattaactcatcatttacattaggtatttctcctaatgctatccctccccctacaacccaccccatgacaggctcctgtgtgtgatgttccccaccctgtgtccaag

SEQ ID NO: 388354 - DNA, 829 bp, Homo sapiens
ttcccttccttggatccctgtgcacctactggagccaggttactctgggtcctggacctgactgcctcattctggaggcttccagacagccacggttagtgcccaaacctgagaggatggcttcagatggagcatctgcattgccgggaccggatatgagcatgaaacctagtgccgccctgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggacgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttc

SEQ ID NO: 388355 - DNA, 479 bp, Homo sapiens
gtgtaaattttctggttatgtaatcagagcttaattggccatttatagttagttggttaagcttaaattttgttttccccaatgcaatttacaaaaatttacaaaaaaaaaaatatacgtttgaggatacacacttcacaagagactgatttttttttttcccctgaattttttaaatgtgtcccaagtgcggtctcaagtctagccctcatcccccattcctccagcctaactcaggcttgaagtaaaatactaaatttccagttccttctgacaatcccaaatgccagcctcgtttccctagttcacattgtcatctatttgtcctttagtgtatattttcaatactgtatttttttttacaaaccactggatggcacattttaaaagattcattttctgtttgtaaatatttcccatgagaagaaagcaaagaataacccctgacactgtgttgtgtaaaatctctgtgcctcttt

SEQ ID NO: 388356 - DNA, 263 bp, Homo sapiens
aagaataaacttttttgtgtgttaaagatttttgggcctataatcccagcactttgggatgccgctgtggaaggatcagttgagtccaggggtttgagatgagcctggccatcataggcagactctgtctctacaaattttaaaaaactagtcaattacagtggaggacacctgtggtcccagctacttgggaggagatcacttgggcctgagaggtcaaggctgcagtgagccttgattgtaccactgcactccagcctggg

SEQ ID NO: 388357 - DNA, 373 bp, Homo sapiens
ctcaaaggcactggcttctccttagaaaatcacctcagagaagggtgcccatgataaaagcacagcctgagagtcacttaaggagctgtgtccgtgccatgacgacagcatgagctccctgcctgtagatatatatatgtctgaatgaggcactgtcccgatgatggcatccttcttttgagtagctggggtccccacagtgccaacagcactttgtggctgtgcactgctccaccaccttaggggcaggggttggcaaagcaggctgctttaggtattaaagggctgtaagtagactcccaattcataactgcctgcccctctaggaagcatccccatgttggtgacacggcagtcattttcctgaagttgg

SEQ ID NO: 388358 - DNA, 727 bp, Homo sapiens
agggatttttaagccaagttgtagaatggggtgggtgtaatttcagcagtgaaggggaccatgggtgtttgaagtcaagagtgagacgctggaaaaaagacaaaagaatgggaaaaagtggattgagtatataagcacaaatgcagtgctaagccattgattttaagtgaatgtagagagagtcaatttgggctgtagtatcctggactaggaaggacatctccctggactaggtagggtagctgctgtttagctccagcagaattttcacatgcggggataaaccagaaatctgcattttttaatgaggaatcttccaattttaaaatgtttgcaaataacacaaaatgcttttaaaacattatacagacaacatgtgagtgggcctcactgagccattgggcttccactttgtggcctttggagtagaccaatggttttccaagtatgggtcctgaccagcagcatcagcatcacttgagaacttgttagaaatgtaaatccatttccaagtgaattagaaaccctgggggtgtcagcaatctcttttaataaaccctttagcgattctgatgcatgctaaagtttgagaaccagtgaaacagagtattttggaacctcgcttggtgcctaaatcatactagtctcaaaatttttgtcgaagagtagttgaaagtgaactgagggatataaatttggatgatggttgataccagattatgaatta

SEQ ID NO: 388359 - DNA, 524 bp, Homo sapiens
tctctactcagccggggccatgttgcctgcttcttttactgtacatttagcgactggtactcggcaggcttttcctattggcacagctgccaacattcaccctgcgcaagcttccagcttgcttatctgtgtctgcagctcgattttacaggctgctctttgttagaaaagaaattatttggggttgctttttgttaaaaggcaagccttgccaaggactcctttaccctcactatctgcctaaataacttctttttagctcctgtagcaaaatgaccttttctgggtggttatgaagtagatccctggagaggggcatgtggtggctgttgaatgagccaatgtctgttctgggaagtcagggaccctgaacggaggtaccggctgaagctgtggcagaagaacataaattgtgaagatttcatggacatttatcacttctccaatcaatactcttataatttcctatgattgtctttactttaatctcttaatcccaccatctttgtaagctgaggatgttt

SEQ ID NO: 388360 - DNA, 220 bp, Homo sapiens
agaggctatagggaatgtggaaaaaatggaaacagctgatttgctagaagtggtgcaatgaaaggtgattgtatttctgttttcttttattattgtttccatgttgtttgcacaataataatgtgaaaaaaagagaaagggagcgagagaaaatgaagtagagaatatgagcactcgctctggagtccaggagtctaaggccatcatcccttgctctact

SEQ ID NO: 388361 - DNA, 565 bp, Homo sapiens
ggcatacatgacacctgtaggaacaactgctctgatttgcacctttggcgactgagacaaatgctcattttacttagtaacattgcgacagcctgtagcaaaactcttaacattataaaggaagagataggcatttcaaactgtgtaagagaaaagacacaaactctaggggttttgactggcccagttagggcagagtttttaaaactcagagcctcttacctgcaggaaagagagagaggaggcagggttttggaagagaggcagacccacagttttgcatcgctcgcactcgccttccaggatcccgggggaggacccatttgaaatgggaaaggttctcttgcccccctcgcagggcatgcggtaggagtgtggctcgcttcttcagagccccgctgcttcaaagtattggctgacccacttgttaggtactaatgcagctggtcactttaagttgaagccgatgctcatttaccattctgaaaatcctgggtcccttaagaattgtgccaaatctcctctgtttgtgctctgtaaatggaacagtaaagcttggatgagg

SEQ ID NO: 388362 - DNA, 836 bp, Homo sapiens
tgagacaaggtctcactttctcacccaggctggagtccagtggcgcaatcatggctcactgcatgcagactcaacctccccaggtcaagagatcctcccacctcagcctcctgatagctagtaccagaggtacacaccaccatgccctggctaattttcaaattttttgtagagagggggctctcactatgttgccgagtttggtctcgaactgctgggctcaagtgatccactggcttcgaccaccccaaagtggtgggattacaggcatgagccactgtgcctagcctattctttctacaaggttgactgaccccatagccattgtcttcatccagagctaaccaatgtctctttgcataagagataatacttttcatctaacggagatctaatcttacctttgctgagtgactgagtaaaacaactccaaacatcaagtaacaatttatactactccataacatgtgttgatagttacattcgattataactgaatctaaaattctcagaactaccaagccttaaagcaaaaagaaaaaaaaaataagtaactgcaggagaaaaaagaaacaatattatattcagaagaaagtagaagtatgactactgtccccactgtgatttcctaaaactttacagcatctcttctcagttaaaaagtactctctactaaaaatatgaaaaaattagctgggcatggtggctggcccctgtaatcccagctactcaggaggctgaggcataagtatcatttgaaactggaaggtggaggttgcagtgagctgagatcgcaccactacactccagcctggaacagagcgagactccgtctt

SEQ ID NO: 388363 - DNA, 964 bp, Homo sapiens
atactctttatgtgttagccatttgtcttagtgactcataaatcagaaataacattactaatgttgtttggaaaacttttaaaaaattaaaatttgtaataattgaacaaaatagtagtgaagtggataaattatagtccgattcttgagtgtttgattaagggagaaaggaacttactttctgacacatataaatattttcagcatacaataacattatgtttgaatgttttcctttagtcttatttgaaaatctttgattctttactgatattggagttacgtatgtttcagctaaatgttacatttaataacagaagaaagtttagtgcctgaaaagatacaaattatcgttgtgtaagatttcacatttaaacagcaatattaaaaaaactgaattaggactataggaaagtatcacgccattctaaaaaatgtgtagaatatacttggaaaaatttcttatgcaaagttccacataacagaacgaaaagatcactcgctcgtgtaagttttcagttaaagaagaaagttatgttaatttggtaaaataaaaaacaggccttttcaattaagagatactattaaacccctagttatgatagtgatgatgctgttcataagaagtattgatggagaacttactggtcagagtctatgcaggcaaatgaaacacttcttttacttgggatctttcgttgtgaaagatcttacagcctaaaaacatgacggttcaacatgcagttgaataaatgtttagcgaatcgagtaaatgtagggaaaataaaactagctacattaggatgttaggattgctttcccgtatttaatttgagctgttaacactttcctgtttatactgttaattttgcaaacagtaatgcttgtgatcccatacactttgtctagtaaaatgaaatcttccaaatggagaaaataaacctctatagtacggatttttgcc

SEQ ID NO: 388364 - DNA, 261 bp, Homo sapiens
cagcccactagcctcatatcctcatctctatcatgagtgatttgatgaagacaattcccaagtgcacttccagtcttgacattctgcaagtctcaaattcctgtagtatgtcccacagggatcctctcttctgcgagctcatagcctgaaacgatcacttgacaattaaccacatatcaccccatggcatctgtcttgttgtcatgtgttatttaactttacagaagagcagtctcacatccaaagcatgtcggcaggacc

SEQ ID NO: 388365 - DNA, 680 bp, Homo sapiens
agcgggacaggaggaggggaagaacagacactggggcctattggagggtggagagggaaggagagagaagatcagaaaaataactattgggtattaggcttaatatttgagtgacaaaataatctgtacaacaaatccccatgacacaagtttacctatagaatagacctgcacatatacccctgaacctaaaagtttttttaaaaaaaatgggcaaaagacctcaagctggaaaccatcattctcagcaaactaacacagaaacagaaaaccaaataccccatgttctcactcataagtgggagttgaacagtgagaacacatgggcacagagaggggaacatcacatactggggcatgtcagtgggtgggggccaaggagagggagagcattaggacaaatatctaatgcatgcagggcttaaaacctaggttgataggtgcagcaaaccaccatggcacatgtatacctgtgtaacatttacatagacatttctcaagggaagacataaaggacacattttaaaagccctaataaaattattagttcagcttccagttattccttattattggtcttgctttaaccttgtacccaggtttctacaactaggccacctccttgctttctagtttcaacaaataagcccgtcttatcctgctctgttaacatgatagag

SEQ ID NO: 388366 - DNA, 482 bp, Homo sapiens
  misc_feature (218)..(218): n is a, c, g, or t
agagagctagcaccatgagcttcaataccctgctattccccatctgcaatatcatcctctttaactgtgtgttcattttctgccttacacattaggctatacgctacacaagggcataagctgactgcctttcttgtccattgtcaccagtgagcaagcctcgcatggtgcctggcacatattataaacacattaagtactagataaataaataaagnaaatcttgactagcagagtaggctcaaaatatctgtagacagtgaaacaagaaacagaaaccaagccttgaaatcactgaagagtaaagagctgaacacctgtcagatttttctgggaatcaaggaaggcaacaagaataaatgagaaaatgtgtacatatagagaactaagatgctctaatatgccaagttcaaactggaatggccctagaatctgagtcatgccctagcaggttaattaatacacccagtgaattgtgtcac

SEQ ID NO: 388367 - DNA, 1186 bp, Homo sapiens
  misc_feature (922)..(922): n is a, c, g, or t
atcccagctacatgacaggctgaggcaggagaattgcttgaaccctggaggcagaggttgcagctctgtcttaaaaaaaaaagcaaaaaaactttatcttttaattattttgttatataaccggaactacagaaacttattaaaaactatgtgaatatcacaaacctgtacaccattgttcccattttacagaggtccctttcagccctaacgtcgtggggaccagcagctgaacaaagcagtctccccatgtgtaatgtagggcagaatgtggcctacttcaggccagctgtttaccaaatattattccagatattgctcataagacaatctgaagcctgacgaaggcccctccttcacccatatgagaatgttcaggatgctaacttctaactgatacaggagattcaaatgcaaggagcaccaaacagtgcagatgtaggaggcaaggcttcctgagagacagctggctcaaggcaaactgaatgaagacagtcaattaccataatcaatggaacacacccctcctatctttattcaaagtagtattaaccaagatgatgaatcatcagctcagtgggttttaactcctagcagactgttcactgctccacatatatctatgcctcatctagagcatctgaattgaaatcataaagcttcactgtgcataccaccgtatctgttttatcagctctaacttagctgtcatgtcacacactcccataggcccctgctattccccatctgcaatatcatcctctttaactgtgtgttcattttctgccttacacattaggctatacgctacacaagggcataagctgactgcctttcttgtccattgtcaccagtgagcaagcctcgcatggtgcctggcacatattataaacacattaagtactagataaataaataaagnaaatcttgactagcagagtaggctcaaaatatctgtagacagtgaaacaagaaacagaaaccaagccttgaaatcactgaagagtaaagagctgaacacctgtcagatttttctgggaatcaaggaaggcaacaagaataaatgagaaaatgtgtacatatagagaactaagatgctctaatatgccaagttcaaactggaatggccctagaatctgagtcatgccctagcaggttaattaatacacccagtgaattgtgtcac

SEQ ID NO: 388368 - DNA, 758 bp, Homo sapiens
tgataaagcaataaaatgctattcacagctgcatgaggctacacccttcttttgaatgcagatgctattacttctcctttgttttctttgaattgctttgtccaccctagaactttttgagtgacattactaaaccttttcttatgccccgtggtgtctccggtaagggttagactaaattggtgaagttatatcattaaaagtttagtatagtacttattctgataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcagaaactatgagcagtctaacctgttggagatttttagacaaatttctttaggaggaatatattttaagacaatatcctctttaggagaaataaagggaagaattatctgttaacctccaaagtagtatgttttcctataattctgtttttggttacacatagagttgaagtcttccattatttatcagccaaatattcagtgagaaactacaagctggggtagaaaatgagacttagtttctgccttgactgtattctagttggggtgggaagtggaaagacaatcactagataatatttctaacactgtggcaagtgttaaaatagaggtatata

SEQ ID NO: 388369 - DNA, 352 bp, Homo sapiens
gatgacttgggtccttcttggcagtagcattgccagctgatggccttggacagttacctgccctctctaggcctccctttccttgtctatgaaatacattatagaataggatgtagtgtgtgaggattttttggaggttaaacgagtgaatatatttaaggcgctttcaccagtgcctgggatgtgctctgtagtttctgtgtgttaactataaggttgactttatgctcattccctcctctcccacaaatgtcgccttggaaagacggaggcagcctggtggaggtgtatctcctagacaccagcatacagagtgaccaccgggaaatcgagggcagggtcatggtcaccg

SEQ ID NO: 388370 - DNA, 175 bp, Homo sapiens
aaaaacaaacatgacttggtgaatgttgagcatgcccaggcctgatccccagaggcaattacgcactcaagttacttaattctactcacaatgcctcacaaacaacttctctgacacctaacacagctctgggcaccttctagcttcagctcctcaaagcagttattcacgctac

SEQ ID NO: 388371 - DNA, 473 bp, Homo sapiens
ctggggagaaagcaggaggccctttttgttcctggggagatgcttcaggccaaagccctgcccccaagtcatcctggatgaaccacctcagactcctgacctggctgacagaatcaatggcccacaacatcccccggcccaggcccccttctgcgcccccaggctgctctggctcaggccctctttgccacaagggacttcagcaagtgttagggacggggttctgcacattcagccagatgcggtgccttcctccacacccaaccagaaggcccgaagcatccagaaggaaaagcgctgcctgaagccctgagctctggggacaaatcccaggggccaatgtggagggcacgcggggcactgcttaactggaagtgatggggaggggctccctgaggccagagggtggatctcgagcctgaccacagggccgtggaccgtggcccctcggtcccggagccaccagcggccgc

SEQ ID NO: 388372 - DNA, 681 bp, Homo sapiens
gacagattttcactaagaaaagttagttctctaccttatataatgcataaaagaaatattccagatggaatacaaatccacatgtaaaactaaaaccattcaaatatcaaaagataatgatttgacaggtaaagagcttggaagttatcactgctgtccccacaacaagaaaaaagctcagcaaatggaaaatcaacaactcttctcagatccatcagagaaatgaggtcatggggcaaactgctatcctgaaaactggagagacaggtgaatgcagagaatcagaacttacctgagaagccaggaacagaagctgctgctggagccagtactgtcaggacactcacaggccaactgacaaatgtaattagcacagaaatgagaagccaggcatggtgtgcacctgtagtcccagctacttgcggggcaggggcagaaggatctcttgagcccaggagtctgaggctgcagttactattttcaattactaaagcagttttttaaaagtataatccccacttctggaaaatgatggtgtaattggtatacattgttttagggcagcattaaactggtttacattagtacatgatgacactgaaatacatattgatacatatccattgtcataaaaatgttcacacctattaactaaagaatctcagtttagagtattttgtc

SEQ ID NO: 388373 - DNA, 341 bp, Homo sapiens
aggcatgcaccaccacgcctggctaattttttattttttatagagatggggtctccctatgtagtcgaggctggtctcaaactcctgggctcaagcaatcctcctgcctcagcctcccaaagcgctgggattataggcatgagccaccgcacccagctgatttttcatttctaaccccaatgcagctggtccacagaccacactttgagtaggaaggccttagatgtccagatttttctctgtattatgtaatcctccatccaaatgtctagaaaccaaaagcagaacaaaaagcaaccactgtcaatttaataaggccaataaaggttactttcgggtga

SEQ ID NO: 388374 - DNA, 628 bp, Homo sapiens
aaatacattcaaattgagtcatcatcatttttcatctatgtagtattttgtttttccaaagttcttacaatttctgactccaagatggcaaaattgtaccattattcctatgttaaagttaatgccatgtctactatagcttggacagccattttgactcaactgtctaatctaaatgtcatttcaatcagaaaaccagccatcaactgtcaaaatggtaaaaacagttatgtgtgttttcaaagccagaagtgcaatcatgtggtgagacttcagggttttactgttgtccacagttctgagtcccaggactggtttccttactcggtattctcccatggaaaacttcatcggggaattatagggtaatattttcaagacttggaatatgtctacagttacctttctaaaaaacaaacaaaaaaatccatttaaaagcatttttttaaaaataatcatgccagggtagccaaatagaagcaactttggggtttttgcagagtcaagtcttataaattgtggaatattccccttggtccaggagatcatttgactcccacacaccaccacttcctatatccacaaattccagtatgtttggaccctcctgatggctgagagaatccca

SEQ ID NO: 388375 - DNA, 122 bp, Homo sapiens
ggttgctggagaaaacttaaagtactcagtaaacatttgctcttttttttcttttagacaggatctgtctgtactctgtacagcctgtactctgccaggctggagtacaatggcatgaagac

SEQ ID NO: 388376 - DNA, 417 bp, Homo sapiens
gccaattttttgtatttttagtagagacggggtgttcaccgttttagctaggatggtctccatctcctgtcctcatgatccgcccgcctcggcctcccaaagtgctgggattacaggcatgagcctccgcacccgaataaagaaaactaaagaaatgtagcagataaatgcaatatgtgaccctgattttgatcctagttaaaaaacattagtggaaccatgaacaaaatatgtaaataaggtctgtaggtaagtaactaattctgtatcaatttcctaatgtgagtaactgtactcttagatatggtgttagcagtcaagaagctgggtgaagaatatataggaattcttgatttttttaaatatatttttgtaagctttaaagtagttcaaaatgaaaattttaaaataaaatga

SEQ ID NO: 388377 - DNA, 881 bp, Homo sapiens
ccgcgcggcctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggacctgggtgcgacgggggccagcgacagccgtgcacaacgagagtccacctgaaggaggtggccagtgcagcttctgacggtcttctgcgcctggatcttgatgttccggacagtgggccaacagtgtttgcaccccaggaagtcatgtcagttgaagccacaagctcgggagacaacccgggccctcatgactcctaccaagcctttctagcaactgagacaccagcctggtgaaagggtggagaaccctgaggggggagagaagaccaagccctgtatcaagcgagccagagagtctccctgaggagcaaagagaacagaaaccacgagaagagaacagggacagaagagacaccaagaggaccgactgagaaatgagggaaatggagaacccagaccca

SEQ ID NO: 388378 - DNA, 256 bp, Homo sapiens
cgtgatgagtgactttgggcaaatcccttagtctctctagacttcagtttcctctctacaagagaagataagacaacagggtatctttttgctcagaattctatgcttctgggatctctacaaagaaaaagaaaaagaaaaattagccaggcatggtggtgtacatctgcggtctcggcactgtacaaaaataaatcgacttttaggaatttcttctgctctcgctctctctctcgctctctctctcgctcgcttt

SEQ ID NO: 388379 - DNA, 173 bp, Homo sapiens
gcaggggccctgggagctgagatgagccgcagcacaggaccttgaagctgaaaagagccaccaaggggtctccatcccttcccagcactggccttcctcctgtgggatactcagtgtggagattcctccctccccacctgacacagagatgggagtgaaatgaaacacagccc

SEQ ID NO: 388380 - DNA, 1622 bp, Homo sapiens
gaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattggtccatatcttaacactggccaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataacgtgtctatggccaaaataaaacctgaaatccctgtcctatttcccagaggtaactgctgttaatagtttagttgtgtgcttccagacataccttcacagaatcatttatcacaataaaggtgtcatactatgcaaaaaaaaa

SEQ ID NO: 388381 - DNA, 419 bp, Homo sapiens
ggaacctgacaaatgtaaaaaatgtggcagtctttaaaaactgcttcattatacatggcttcactaatttcatactgaataaaagtggtatgagcataatgactgtttaaggatgtttcacaaaatgtaagcttcagagtgcacaacactatactgaatgaaatttataaatataaaagattacaatatctttatttcaaagatcttcctgtaaacagaatctgtactagaggaaaaacccttaaacaattattcagactttattcaactttagaggattttacgggggcaaaaaacctcctacaaatgtggaaaaacattttttcaagatatatgccttagaaaacaccagagtttatagtatagtagaatatattttacagatacagtgaatacaaacaaatgtccaaaattaagtc

SEQ ID NO: 388382 - DNA, 390 bp, Homo sapiens
gtttccttgactgcatcatcccaggctggctactccttttcttcaacacatacataaaattccacactaggtagtctttaaaaaacaattttccagtaatgggattgctgggtcaagtggtacttctggttctagatccttgaggaattgacacactattttccacaatggctaaactaatgtacactcccaccaacggggtaaaagcattcctgtttctccacatcctctccagcatttgttgtttcctgactttttaatgattaccattgtaactggcatgagatggtatctcattgtggttttgatttgcatttctctaatgaccagtgatgatgagctttttttcatatgcttgttggccacataaatgtcttcttttgagaaatg

SEQ ID NO: 388383 - DNA, 315 bp, Homo sapiens
tcaactaattttttgtatttttagtagaaacggggtttcaccatattagccaggctggtctcgaactcctgccctcaggtgatccgccctcctcggcctcccagagtgctgggattttaggtgtgagccaccgcgccagccgtcactgtacttttaaaaccttttttctgcctagcttcattttcttattctattgaaatagaatataaatggaataaatattctattgattattacaatgataagctgtcagttctttaggatcaatgacattgttatgtattggactttctttgtcacagtaggagttagtat

SEQ ID NO: 388384 - DNA, 393 bp, Homo sapiens
gactcaattctcattgtcttctttctctttctaaaatataaacaaatttccccttcaacctaaaattgggagatagtgaagaagctcagcttttatagtaggaatataataagatttcattctgaaacactatgtaatcagccattactaccatacaaatgttattttagaaaaaatgttgaatgtctagtgacttcagcaatttagtttttggtcttggaccagtcataagtaccatatcagagcctggtatgatctgggttgacattcacatcctgagctgaactcctgagcaattcttgcactttgatgcaagtcagttatttacccaatcttttccatataccatttgactttcatttcagaattgcaaaaagtattccatggttttgg

SEQ ID NO: 388385 - DNA, 869 bp, Homo sapiens
ggctgcgcgcgccgcggaggcggtgggaaaggcacgcggctcgtccggcgtctcctgggggctttgcctgcgggcgggcagggaggaagacagctggggccgtttgctctactacctgccctggcattaagggaacaaagtgaccaaacccagtgccagcgtttactaagcacctactacgtgcaaggcactgggcaatccgagaggaagaggcctcagtctccaggaagggtggaccttaagatggattggctggaaggcgacagcccgagcacaagacagacgcgttagaggccaatactaaggtcattcattctgccagagtatggaggaaggctttcaggagtggtcgccaaggtggcctttcagctggatcccggaggagcggatataaccaggagggcacttcacagccttctgtgcttaggaactctatacagcacttcagcaatagatttgggggccactttaaacagcaaaatcaccaacggaaagcaaaacatgtgatggctcggcacagtggcatgtgcctatagtcccagctactcaggaggctgagacaggagggtcacttgagcccaggagtttgagtccagcctggtcaacatagagagatcctgtttctaaaaacaaaaaaatcatggcaccaaatagaccatggaaaggacactcgtttacagtacgagagttgaaacaagaaggcagaatcttgtcttgtttggcctcagctggcaacgttcccgtagggtgactcaagtatctcgttactgtgcatgttcaaaagtgactacaaaggtgctatgactacttcgaggttacaaataagtttcagcaataggcaaatttgcaaacagaatctgtgaataatg

SEQ ID NO: 388386 - DNA, 386 bp, Homo sapiens
tacttgagtttgaattctggctttgaatcttagtaactgtgtgaccttaggcaagttaccttacctctctgttttagtttcctgatccacacaatagagatactaacagtacctgccttctggggttgttaagaaatgtaaatgagttaatgcatgtacagtgcttatgacagtggccctgtttagctacataagtgtagcctaaatatcctacatgtatatacacacagccctacacagaccaagtggtcctgtttagctatatacatataagctaaatgcccacaacacagtgtgagtcttataggacactctttaaattaatagtgggcaacctctggcttaaacccattctttctgtaggtgaatcctaagtagtccgatca

SEQ ID NO: 388387 - DNA, 427 bp, Homo sapiens
ttaggtctctgaatgtgataagaaacaaatcctattgatgagaagaattatagtagctttaaggttgcaatggtttagatcaaaaaaagtaaaacagattcttgagatattaaggtgacaaatctattgcattggtggctaagagatgtcaataatgattcctaaatttctggcttacacaactacatacatattgacaccattcactgagattaaaaaaaaaaataggagaggagtttggaagaaaatatcacaaattcaattttggacaagctgagtcagaacttttaaaatctaagaggaaatgtaatctggaatgtcagatatatgaatctggagctacctgaactagaaacacttgaaagtattaaggtatcgataactaaagcttaggataaaaacagagacaagtaaaagcccaaatttt

SEQ ID NO: 388388 - DNA, 415 bp, Homo sapiens
atgggcatctctacctgtgcatcaggatgtcatttttttgagttgcgtagagaaggttctactcccacagcttgcatattgtccatgtctgtattaatcttgttatgaggcatcaactcagcatgggtaataggtagttacattaatgccagggctcaaggagtcccacccatttctttcaccaaatagcccacgaaagtgatgagagataggatgaccacatatataccgtaaacaccagaatgaaggcctttgtcactgctttccccctcagtgaaaaagtaggaaatgtttttaagtccctgctgttgtttgaatatttgattctccaaacctcatgttgaaatttggttcctaatgttggaggaggggccaaatggaggtgtttgggtcatggtcagtagctccctacagt

SEQ ID NO: 388389 - DNA, 540 bp, Homo sapiens
ctcagactcctgagtagctgggaccacaggcatgtgccgccgtgcccagctaatttattttactttttgtagaaacagggtcttcctgtgttgtgtaggcctcagccttctggggttggcttacctcagtctcctaaagtgttgggattataggcatgagccactgtgctcagcccccttttgttttcattacaagtttgcttttataacttagataaaggtgggaagacagttttcacaattaaggcagaacaagagataaagaaacataaagggagagttgtctttgtgggaagaaagtgctttctgtgaaagcacttttagcaggactgctgttttcaggccagagtagaagggccagaagcagtttttattcagatttcctcatcgtttccatcaaggtctcagtgactgtaaaggatgggttgaaatcagtctggactaagtgtggtttgctgctgctgcttatgaggattaagtgtctcgtttgtccggaggcccctctggtcacatgtagctgagcaggtggagtgatatgaa

SEQ ID NO: 388390 - DNA, 2512 bp, Homo sapiens
  misc_feature (909)..(909): n is a, c, g, or t
  misc_feature (960)..(960): n is a, c, g, or t
  misc_feature (1398)..(1398): n is a, c, g, or t
  misc_feature (1503)..(1503): n is a, c, g, or t
  misc_feature (1634)..(1634): n is a, c, g, or t
  misc_feature (2198)..(2198): n is a, c, g, or t
agtttagtttagtttagtttagtttagtttagtttagtttagtttagttttttaagacagggtctcgctctgtcacccaggctggagtgcaatggcatgatcatggctcactgcaaccttggcgtcccaggctcaagcgattctctcatttttgtctcccaagtggctggagctgcaggcatgcaccaccatgcctggctaatttaaacattttttgtagagaaggggtttaccagtgtggcccacgctggtcttgaactcctgggctcaggcgatcctcctgctttggcctcccaaattgttgggattataggcgtgagccactgcacctggtcccccagaagctaaaggatggtgcaggttctgtttttaaatgtacctgttaagtatgtattagctcaaacagagtttacctgagatgtgcatctggggtccaccctctttggcactgtccctcattttcctcctccaacattctcccaatctctctctgttaaccccaacaacctgccacccctccctaacaaaggattcccagctcaaggccaattccaattggatcgagtttttcttctgcagaaattgtggggaggtggcttcagaggctcacaagcagaaccccacccagacacataaacctttctttggctggtaccaactcctctattgcagggtatggtccaagtaggttatacaagtctctacctcttctagctgaagccaacctcccaggaaaaggatgagaggagaaagccatcctgcctggtgtgtggataataccaccaccagagtctcctgtaattttgattcgatggcatgcagctgcgtgacctaaggcacgtatctccattcacagggtgtggtcagtactctgtgaatatcaggtgttctgtctgccctgtctcctgncttcctggagcctgcccttacccagtgagtccctggagggaacattctggnatctggctgtgagctgtcacagacatgggtttctttcggttcccagaatgatgggatgccagccgctggctgcccccaagaaacttgggagcaggacaggcttggctgtcccagaggaagagcctggcattgggccaggaggctcaggagggaagatgagctcattctgcccagctcggttctcccgtatgcagaccaggtcatcacagggacctgcctccacatttgcatcccccacggcatattttcccagcacatgcagcattgggaacttgaacgtccctctgcttttccttggtgagacccaccagccccgccttaggaaggaggctgaacatttgacggagctttcctgtcacctgtgagcgacgtgcacgctgcttccgaagaaagagacatccccctactgttttctcacagtgggatgattcaactttntctttctcacaatcccagataatcatatcttcccaggttttgtcatctttgaggactactcactatctagttatgagtcaaacaaaacccaatttaactgataantaaccagccatcacgtatccctgaagataaacctggtttatcctttttataccctctggcagagcaaaggaacaaggagtttgggagagaaaaaaaaacacaacactagaaacagcactgacacaggtcgntaaatacagatgtgaccagccttgattacaagtgttgtcatcctcttttaacagggacctaccccgaactttcatgaacccctggtagctgaatagcagcttgtctaagcgaggtgcagggattttgtcaaagtcggcctcggtgttaaaggcagggccacctaccatgaacttctctctgtgactttattctttagcagtgctcaagtgtaaataaacttgtttaccaggatcagaatggccatgttaatgaagtcttatttgtgtcaccacaatgacaagtaatttgtgcacagctggactcggagaggggacaaaaccagagaaattgtatttctgttctgaagtttccatacagatgccttaggccaaagttagtacagccaatatttgcctgtttctttggattgtgtgtccatgctggagaaaagccttgttactgtgcccagtgtggtaaacgaaattatatgtacgcagtgagaagaaaaatgaaataagaagcactgatgaatgtacccacgggtgtgaccttgggggccagtgtgtggtttttatgaaatgaangcatgaatacgaggaccctaattattgctttcaacggacaaagtatggtgaatatatagagaacgttgctgtacaacactggctgtgtctcaaagcggctttagaagtaaatatagaaattctttggtacatggtattgcatagaaaagtcattaagaaaaaagcaagacaatttgttaagaccttgttaagtggagctgggggatgattaattttgtttgtttgtttttgttgttccctggtagagctcaacaaactacagaccatgggccaaatctgacccaccgctgcttttgtaaataaaactttattgg

SEQ ID NO: 388391 - DNA, 250 bp, Homo sapiens
aggaagaagaaacaaagccaacttgtaaataataatgaggagagaccctcgactgagtcaggtttgaacatatcagctgtaaaagacatttcgaagatgactgaggaacaacaggcacaaagcagattgttaaattgcagtattaagggtgacaatgctaataacattaagtagaaaaatgttactgtaggtacacaagtacactattttgagtgaaatatgaacctttctttcaagtaagagtctgctc

SEQ ID NO: 388392 - DNA, 579 bp, Homo sapiens
  misc_feature (96)..(96): n is a, c, g, or t
ataagtccaaatattgctcacctcagggccagcctgtgacagggtacccacaggatggttcatattgaaaactggggggaccatgctcgggggagntggtgtagctctgaggtctgggaaaccattccagctcctgccagttttaacttgtgtttaattcctggcacagttgtcctggaaatgcctttttctcttgcctgggaaccactagaaggggatgttgtctgtgttggccagggccatgcaaattcaacatcttgtttctgcccttcccccgtgtagctgaggctaggtgttggcattacccagtgcttgttcttcagagagcaaaagcactgctcgtcatgtctgaaatttagtgagtgagctcacccactaggctggtgtttcctgcccgtggctgcacattggaagcaccggggcactttgagaactacagatgcctgggtcccagagcatctaaggtgctctagggtgtgtccaggacacagccctggttgaggaccactgctatattgtatggcctcttttaaaaaagttaattttacttgactactcctaagctcggggagtcacctc

SEQ ID NO: 388393 - DNA, 1038 bp, Homo sapiens
ggcaagaatgtttgtgacctttcactaccaccacctcccccgagcatggtccccccagttttcaatatgaaccatcctgtgggtaccctgtcacaggctggccctgaggtgagcaatatttggactgtgatgttggttgttctccactctttctacaggacagaacagggcctctagagtgggaaatggctttgggaaatatgccaagcagtagccttgttcttcaacttgcccaagaggataattctccacacccttcctgtactcagtcctcagtttgcctggtgagagagcagcctcctcccgtgtgctctgccagctggacccagactggccatattaccagtgagaccaaaaagatggaggtggggaggtagctctgaggtctgggaaaccattccagctcctgccagttttaacttgtgtttaattcctggcacagttgtcctggaaatgcctttttctcttgcctgggaaccactagaaggggatgttgtctgtgttggccagggccatgcaaattcaacatcttgtttctgcccttcccccgtgtagctgaggctaggtgttggcattacccagtgcttgttcttcagagagcaaaagcactgctcgtcatgtctgaaatttagtgagtgagctcacccactaggctggtgtttcctgcccgtggctgcacattggaagcaccggggcactttgagaactacagatgcctgggtcccagagcatctaaggtgctctagggtgtgtccaggacacagccctggttgaggaccactgctatattgtatggcctcttttaaaaaagttaattttacttggaaatgatttcaaagctacagaaaagttgcaagaataaaaactgtacaaatgaggctcaaatatcctttgcccagatacacctattaacatttcgtcccattctatctgtcatgtgtgttctcaaatgtgtgtgcgttctctctcccttgcgccaaccccctgtctctccctctccctccctcctgctgcctccacacctgtcatggcctttta

SEQ ID NO: 388394 - DNA, 427 bp, Homo sapiens
cagcatgggagctttggggttttaaaacaaattttttaagccagtcatatttagcagtggggggttgtataccaactttagtgacactaatgttattaaattctaataacccactaccatcagaccagcccagcttgggagttttgacctgctccatttccgacctgggctgtttcacccctccatagacaacctggatagtcccctgtcctgggaggtcaccatgttgaagctgaacttagtgtggacacccaaactgcataatgcattacagtctagaactcctgggctcaagggatcctcccacctcagcctcctgagtagctaggaccacagggtgcaccaccgcgcccagctgtcttcctttttttttctgagaccgagcctcactcagctgtccaagctagagtgcagtggtgtgatctcc

SEQ ID NO: 388395 - DNA, 798 bp, Homo sapiens
tgaaaataaaaataaggatctttttgaaattttggtagcagttgccacctgttctctcagaaaagtaactgcttttacagaaaactctaaataattttcaaaacccagtaaaacatggtctttattgcttatgtattcccttaatttgaagaatatttttaaacgctcaaaaatggaaaattcaatgttggtcatcttaaagattctagatgtatttcagcccaagcttgacaaacaagtgctttaggtatcctcttccctccttagctccttaaggaccacactgtggaaggaagactggaaaggcctcagcaggggagaaaccatgtgatggaggctcagagtggacttctgatctagtagtggcttcaggaagggacgccagacttgccattccagcaggggtcgaggcctccctgtctcgtgaagaggaaggtgtgaaatcctcttatagacacatgattctctttcagtgtattttctttattccatcttgacctcaggatggataactcatcatcccttttggcacggatcaaaatccctggataaatgccaaccttaagtttgcctgcatgtgtgtaaccatggccaaggtaaactggtctcttgggtttcttttgagttgaaatgagctgagctgtttgtttcctctgagccatatacagatgctttttgaactatctttgtgtttgagggaattttttttcatggtatcagcacaccacttcctccaagtcattactttgaaacagttttgtagagggagatattcctgctggccaccagcctagccaa

SEQ ID NO: 388396 - DNA, 592 bp, Homo sapiens
gagggacccattagcagaggcagcgtctggcctcagacatccactcatcaggtccagaccagaccgtgggccttggctgtatcttctgatccactccgttgctaagttcccctctgtacctaaactctgtctccctttacttcacttggctttttagagatttctcagccttggtgtgtgttgtccccagccctgtgatgtacaagtaattgcctgtatacgtgggattagccagcttgctcaggaagtcagtgttgtggttagtgggaaattcagaccggttgagtccaaggaaaccacttttccttagttctgttttctgaaccaaagtccatttgagatgaggggttgtgactagatcttctctggacagttgaatatagagcagggcccccatctgtgtcaccggggctcatgaatcctccttgccaatgactagagtccttgaaggaataagggctgggtcagtgtttcccaacccagaatataactcggagacctcttaagttgtcaggaagccatcccagtgttttgcccgtatcttctaattaataactaccctgccccctcactccgtctcaaaatattcaca

SEQ ID NO: 388397 - DNA, 467 bp, Homo sapiens
aggataaaataaggcgaggccagtcaggctgattgcgacggacctgtcagctcagaaacattgagttagtgtgacgaggaaggatcacttactttaagacagtggaggaagagagaggatagaagagcctattatgcaatggattctttaaaatcaagtcatctttataactattaataagactattcagataaatcatagatctcagtctctagccactttagggaaataggtaaggcatcttgttttttacaagtttgaaatgatgctttcctcctgttgagaaagacactattcataggaaaaagttccatgtccctaagatgaggatctgccgattccatgactgggaatatttaggcgtttcttgctctagtttatgaagctctagaaatacgccacctgtgttaggctggtaagaaagagactcataagttcgcttttctctggatgtgcagaattggttg

SEQ ID NO: 388398 - DNA, 730 bp, Homo sapiens
tgctaggctccagcggctcccggccagcggggacgtggaggtgacatttctctgacccacaggactgtgggcgccctgccgagcgtcgcgcggtcttggggcgacctgcagtggggcccctgcggcgcagcgcgcggtgggactggccgggttcccgcgccgcccagggcctgtgtctgcgccggttcctggcaagggcaccttggccgggcggcccgcgtcccctgcgcttcccacacccacgtgggcggacccggcccgcaagctgggccagcctgcggtttccgggcactggggagtgcgcagagccccgggccagcgaccgcagccggggcccctggcttctcccgagcactttcccccggaccggtccctccagggtggcgggcggcacccagggccggcgctcctcaccaacgcgctgcagctacgggctcaggagggagccgcagcgtcggaggaggaaagcatttaagaatagcacaaagccttaggctcgaggaagcgtgactgcttacgtgttgaaaataaaggttctgtaagtcccaccgcgggtgcatattgaaaagaaagggatcattagcacgcgaccctcgcctaggagtatataaaccgcagcacgactttcggatcacaaaggcagagaaaagaacacattgaaggcttttgctcacttttccaagttgtttcgtttcgttttgtttctaatgtggacgatcatttaaaatgc

SEQ ID NO: 388399 - DNA, 293 bp, Homo sapiens
ttttttacttttgaaggataattttacatgttgcagaattccagtttgtttgcttctctcaacactttaaatatttcactctactctttttttgcttgcatggtttccgaggaaaaaccaggtgtaattcttatccttgctcctctatagataaggtgggttttatttcactgacttctttcagaattttcttttatctttgatttttttgtagtttgaatacattatgcttaggtgtgggtgttttttacatttattctgcttggtgttctctcagctttctggacttgtgg

SEQ ID NO: 388400 - DNA, 1567 bp, Homo sapiens
  misc_feature (339)..(339): n is a, c, g, or t
  misc_feature (1480)..(1480): n is a, c, g, or t
gtgcaaaccaccataaaaaattagattatcagagctttcattctttctagctgaaaatgatgaaggttgacagggttatcccaatgcaaattgctaaactcttcactaagattgcaccacctagaaaatatgacccacaatagtccagagaattagcctcttttttttttttttatggtggagaagtgaaggtgaaaaggcccagagtagaaatttgagcttcttttaggcagcattgagcttacatgttgtcctcaggaagcagtgatacctcaatggtaccatcatggaatattttctccagtgtgattttctgtataatacattagaaagtacttntgagtctatttgaatgagagggcccatattaatgttgagataaagcagtattgccttaatattttcatctctaatgttgactagaattagacacagatagaaaagggttaagagaaacagttatttgttttagtttccaatttcgatagtcttgttttaaaaaaagttttaattgaaattcatgacttaggactcaaaagcaatttgtaaagaagatcaaaacaaccagtgtgattttactatagggatttgaaattttgcacatatccacttattagtaagcggaaggagaaagaacactcatgagattaagctcatcatttcatactttagtttgtaatcttgtcatattgaattctaacgtgtgcagggtaccctgttgggtattgactgagagggtgggaaagtgcaagatgaacattaaagtgccctcaacaagcttacattctggtaaaggagactacttactaaacaaggcagcagaaaataatgctgggcataggcccaggccatggccagtagaagcacaggtagaaaggttcattctggaaaggactccagagaaggtttaatggagaagaaaaactagtcgtacaggaccttggagtgggagaatgtttcccaaattggaaaatccaggaagaagattccaagctgagcaaggaaattgagctgtgaatctaagcacagacagtgggtggcttgcatggattaggaccgtgaattggatatggctcgttgcacatgggtctaagaacattaaaatatgtggctggacaagttacttggggttcaacactagaagtgcacacttattccctaaacattgaagagccattgacttaaagacttcaactttgggggagcaagtgggacagatccatgttttaggtaggtcaacctgggggtaggtgaagatgagttcacaggtaagaaagtgcaagcagagccaggcgcggtggctcacacctgtaatcccagcactttgggaggccgaggcgggtggatcacgaggtcaggagatggagaccatcctgaataacacggtgaaaccctgtctctactaaaaatacaaaaaaatagctgggcgaggtggcgggcgccggtagtcccagctactcgggaggctgaggcaggagantggcgtgaacccgggaggcggagcttgcagtgagccgagatctcgccactgcactccagcctgggcgacagagtgagactccatctc

SEQ ID NO: 388401 - DNA, 2678 bp, Homo sapiens
ggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgtttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaa

SEQ ID NO: 388402 - DNA, 2759 bp, Homo sapiens
ggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgtttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgcttggctttgattacgtaatttgtatccgggaatgtattggtcaattggcattaaacataattaaatggttatgttcagattggatttgttagcacccgatggagattttcataaaaagaataaagatattagagaaaaaatgtgggctgtggaataacatggggggcagaagagtaggtaaaagaagtggaaaaggggcaaagaaggtgtagcaaaacgggtagtggatacatgtgagata

SEQ ID NO: 388403 - DNA, 969 bp, Homo sapiens
ccagttcctgcttctatgaaactaaagccagtaaggtctgcaaaataaacagcaggacagaaattgtgttgtttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaa

SEQ ID NO: 388404 - DNA, 1769 bp, Homo sapiens
ggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacag

SEQ ID NO: 388405 - DNA, 478 bp, Homo sapiens
gctcgacgttgatatgctacacaaagctggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaa

SEQ ID NO: 388406 - DNA, 2635 bp, Homo sapiens
ggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgtttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataacttctaaaagtagatgctattgaaacttctaaaactagg

SEQ ID NO: 388407 - DNA, 2232 bp, Homo sapiens
ggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgtttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaaacgcaactacctgagaagaaacgcaactacctgagaagaaacgcaactacctgagaagaaacgcaactacctgagaagaaacgcaactacctgagaagaaacgcatctacctg

SEQ ID NO: 388408 - DNA, 317 bp, Homo sapiens
gatttagatctgcttatagaagccttgaaacaaaagacccaatttaacaggtagcaaaacattgtaaggctggatgcggtggctcacacctgtaatcccagcactttgggaggccgaggcgggcagatcacttgaggtcagaagttcgagaccagcctggccaacaaggtaaaacccatttctaccaaaaaacacaaaaactagccaggcatagtagtgcttggtcccagctacttgggaggctgaggttggaggatcacttgaaccctggaggcaaaggttacagtgagctgagatcttgccacgttggtccagcc

SEQ ID NO: 388409 - DNA, 639 bp, Homo sapiens
tttaaagccacgtggatagaagctgcttggatgaccacattaagtgaatggccgcatctgtgcactggctctgcagccctgggcagcgacacagagacagcaagcagagcatccatcaccaggattctcagagtctcgccctgtcaccaggctggagtgcagtggcatgaactcagctcactgcaacctccacctcccgggttccagcgattctcctgcctcagcctcccgagtagctgggattacagatgtgcaccaccacgtccagctaatctttgtatttttagtagagatgggatttcaccatgttggccaggctggtctcaaaatcctgacctcaagcaatccacctgcctcggcctcccaaagtgctgggattacaggcgtgagccactgtgcccagcctgtcctctcactcttgaattccttcctgcatgacactaagaacccatgtgacctcccgggatgagccccgatttgggggttcacctgtgataaagtaagctggtgaacagcagggaagcactctgtgtctgtagcttcctgtgagtatgcaatcatttcaaaattaaaagtttgttaaagctataaaaattataaaataaattaataaaaatcattgtctcaatcttcacaaca

SEQ ID NO: 388410 - DNA, 636 bp, Homo sapiens
tcacatagaaaaactgtagagctttttagtctctaagagctttttcgtgcaaggtcacgcagctaattataagtagagcctgaaccggaacctatgtttgttgaccagacaactgtacctctacaaaatgacactaatatgtcaaaagtgaagttgacttgggatgaatatgctgcttgaattaagcttaggaagcctaaagcttaaaatacagtctttgaagcattttcaaagcatagttacttatttagtaagtttgtttccggctgggctggatggctcaaacctacaaccccagaactttgggtggccaaggcaggaggatctcctgagaccaagagttcaagaccagcctgggcaacataatgagacccacatccctataaaaattaaaattaaaattaaaaattagctgggctgtatggcaagcacctgtggttccagctacttgagaggctgaggtgagaggattgcttgcaccctggagggcgaggccatggtgaaccgtgatcacaccactgcacaccagcctgagcgacagagcaagaccctatctctttaatttaattttaaaatgacattaaattaggccgagcatggtggctcacgccttgtttgagaattttgtgcttgttc

SEQ ID NO: 388411 - DNA, 489 bp, Homo sapiens
ggggccgccatctcacactgactcagtgtccatcttgcagaaaggagagttgggacagatttgtcatctgcatgcttcagtatttgggtcctgtaagctgagcgcctggatcaagtggtatggtctgaggtgggaaagcaaagagaagagagtgctgtcctttttcatttggggctagtgtaacattaagaaattttactttattcttggccgggcgtagtgacttaggccggtaatcccagcactttgggaggcggaggcaggcagatcacttgaggtcaggagttcaagaccagcctggccaatgtggtgaaaccccatctctactaaaaatgcaaacattaactgggtgtggtggtgtgcacctgtaatcccagctattcaggaggctgaggtaggagaattgcttgaacccagaaggcggaggctgcagtgagctgagatcacgccactgcactccagcctgggcaacagagtgagacttgctct

SEQ ID NO: 388412 - DNA, 4460 bp, Homo sapiens
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388413 - DNA, 4444 bp, Homo sapiens
agcgcccggctccgcgcgagagccctgccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388414 - DNA, 4695 bp, Homo sapiens
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtaagctgcttttcacatcagaaacatgtacttgttgaagagaagaagagaatgttgccagagtaaaccacctcagaatacctcttcctggccttattattgcatatgtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388415 - DNA, 1784 bp, Homo sapiens
gtctttccttctgtctctttagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388416 - DNA, 1817 bp, Homo sapiens
tgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388417 - DNA, 2329 bp, Homo sapiens
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggtaccccttctctgcagggtactggccactccacaccaggcccttaggaggctagtggtggagatgtgcagagctagcagaggcgaatcttctgggacaggctggaaccacggtgttagggaggagcgaaaggtcctgaatgtctgggatcttctcctcttccctcagagaagactaagcagcagctgcttcagt

SEQ ID NO: 388418 - DNA, 104 bp, Homo sapiens
gatatgctctgagttgctcctgaaatgaagtttagtgacaaatgacctatttctgttctgcttcagcttcatctcagccacagctattaggagggcaaagggtg

SEQ ID NO: 388419 - DNA, 823 bp, Homo sapiens
agggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttagtaagtctgaaccttcttcacagtgccctcctcgcacccctcgctggctccaggacccctcagctgtggaccagttccttgtgtgactctcttctcactgcccctggacatgctgtctctatcttgtacttaattgacgtccatgtggagctggggagagacttttgagtctggtctgaagtccagctccttggtggtaggacccagcagcattgagacctaaaggcagcaggggtactggaaggagggtggagccaggagtgaggaagtctgccattcccctgctggctgtgtcggcttgagcaagtcacttacccttcttgggccttcattccctcctctgtgaaatg

SEQ ID NO: 388420 - DNA, 349 bp, Homo sapiens
gatcagctgagctgcaggaggccttgggatcaggaaatctactgaattactgtcagaacaagagccagcaagctttactgcaaagtgaaaagatgctgtggcagttcctgaaggtgggaagcctgaaggctagctgctcagaagtgtctccccaaagcctggaactccaacctctgtcaactgcaggagaagcacaagcacactgggacccagatcacagaggccttaactcccattagtttttcccccacactatacccaccatctagacacaaaacgttcaccctttaccagaggctcaaaggccatttgggaagaggctaggaaagatggggaatacacgagatgt

SEQ ID NO: 388421 - DNA, 698 bp, Homo sapiens
tcaatacatagataatgagttagtattttcccttttcagagactggccctagagcctggctcaaactgaatagaccagaacttactggtccagatctgacccgctgcgcaatcacagggtaggtgagggaggcccggttaaaagctataatcctgtttggaaacgttctccgtgggtctgtcagtgtctcgggctcggcgcccgcggagcgtgtttccgacggtgccctgccggggtccgcgccgctttggtcctccgcagccgccgtccacagcgcccggctccgcgcgagagccctgccagaggagcggctccggccgccgcgcctgacccttgtccggggtcttccgcacaggttggttcgccccgccggtctggggtccctggtagcagagattgcgctggggacccggagcactgctcctttctcggcagagcgcggaggggagcccgcttgctgcggagcccccggcccgcgcctgccctgcccgcgggtccgggcctcgggggcctccactacgtctacccttgaattggatccggctctactgtccctgccgcacgggaacccccagccggatgagggtctccctgttcactgctgccttgcgccttcccatccgccttggtcctgacctggcccagccgaggccgtccggtgtcgctgcgtttgggctgggcgggaaggtctgtcattg

SEQ ID NO: 388422 - DNA, 4640 bp, Homo sapiens
agcgcccggctccgcgcgagagccctgccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388423 - DNA, 4638 bp, Homo sapiens
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388424 - DNA, 3784 bp, Homo sapiens
tcccctggaatatgggagtctgacctttctaggtcaaattgggtgtctcaaggattcctcccaaaatggagtttgtaggtggagttcctgactaaactgccactttaggatggcgatgcaggtgtcttttccccccagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388425 - DNA, 2113 bp, Homo sapiens
ttatatcttcttgctttttatctttatcagtttttagatgtttatcaattttattgatttttttcctcaaagaactagtttttgtttcattaattttccctattatttttctgttttctattatttacctttctctttcctttccaagagctgatgtttttttctcttcataggtcccaactccatctccaaggccaagggttttcacccctcagtcatcaccagcgatgcccttggcaccttcccatctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttgg

SEQ ID NO: 388426 - DNA, 4101 bp, Homo sapiens
  misc_feature (4080)..(4080): n is a, c, g, or t
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcaggtgacaaggacaatgtattcccctcccttgggaaaccttccagccctccttgggtgcaggtcatggtagatgggcctcattcctcaaggcatgtgctgagggagactgggggcaggtaccaggtgtccttactgcagagaaagggaggctgctcatctccccaactctgctgtaatgggaacagtgtgactgtgagtcactggggactagtccttagggaagccatgagaaggacagcttgcccctctggcctttctccctgcttctttatcagcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttcttctctcngatcctctagatcaccctcac

SEQ ID NO: 388427 - DNA, 1036 bp, Homo sapiens
agcgcccggctccgcgcgagagccctgccagaggagcggctccggccgccgcgcctgacccttgtccggggtcttccgcacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtct

SEQ ID NO: 388428 - DNA, 349 bp, Homo sapiens
agcatagccagttgtcataaactgcaaagaaatttaaacttctaaataaaagtggaaggtaaatattcaagaaaaagtatcaactagccagaaatattacaacctaggaagaaggataagtatttgttactagaaagaacctcaggggaaacagcatgttcaagaaagtaccaggttttagttaagacaagataaaggttggtattgcattgtgcatagtgaaaagggttccacttgctattggtgtcaccacactttcagggtgatcatttctactaactgatattatttctaattcaataccatatctctcttcattgatatgaaattggacatcagtgttaattaa

SEQ ID NO: 388429 - DNA, 440 bp, Homo sapiens
attgctttctgtgaggattatgccaatgtatgttaaccaatactaatgagattaatctcatcacatcattgccaaagatgaagagcatcattaagtgctgaaaagtcttgtgttttttattgaacattgttgtctatcagtcacttacatttctgttttgtgaattgtttattcctattccctttttgtctatttgtttatgaagactttaatgtttttcatatcagggatagtaatttttaaaggtaaagtattagcttatgtattaaatttagttttagagagcagcttctaggaatacatctagtctgttagccaaatagttcagcctttatcatctttacaaatattaggatgaaaaaatgcaggttgcaatgatcttgtcattctgcttatcaaagggctttaatggtggtggctatgatcccagcactttggga

SEQ ID NO: 388430 - DNA, 443 bp, Homo sapiens
gtaatatgaatttcatcagtgtttggatatgtggttctatactagacatgttaaacattttttattttgctgaaactctaatatgttatcagttttgagtctaatatacatagcatttctatttgcaaaaacaaataatcatctcagccttgagatacaaaaggcaattcagtcaatttggagaacttgggttttctcctcagggttgtcctctttttaattcttgttgattcagccataaatcttcccctccaaagaccttgcttttattcccacagcactgaagtctgctcttactttaaagagccacagtaactgctcctaacatgcacatctttattaggaaatgtagggaaccttgaccagatagcgcagagcagctggagcctggaaggtgaagaaatttgggtaaagatgaatgggttattcagatattaaaagtg

SEQ ID NO: 388431 - DNA, 417 bp, Homo sapiens
gatggctaaagtacggccagcttgcctctgagcagttacagcagtggctttactggtgtcagtggccaccaagttaaccatgaggaacgacttaactgtatataacccacataatgcggcagaactgctgtcttctaagagaagtccctggccaacagataatcacctcctcaaagatcaggctctgctgttagaggaatctacagtccagttaaaaaaacctgtccttgcctgaacccagacactttcctcccagaggaaactgaagaacctgaatatggctttgaacagtcatgcaaacctatgcagccaaggaggacctcaaagaaactcccctagaaaacccagaagccagacatgctggtaaaaggataaaagtttttttacagtcagacttttggcctctctgtccctgtg

SEQ ID NO: 388432 - DNA, 875 bp, Homo sapiens
agcctcgagggccatcagttcctaccagagccgctgcgggtgccattccacccatggccggacacaggccctcaaaccacttctgcccccttccaggcagtggtgggggcggccccagagggccgatgcccctgcgggttgacactctgacctggttgagcacccaggcggcccctggcagggtgatggtctggccggcagtcaggccagggatctgcccaggccctgacgtgtggaggattcccctgggtcccctgccacacgaattccggggctggatagcaccctgcaggccccgtcttggagctagtgaggcaggggactggttgcgacgcccctccgaaggcgccctcccggggccctacattgccctgcggagcattccgaagttgccgccgccagaggacatctcgggcatactgaaagagttgcagcaattggccaaggagttgaggcagaagaggttgagcctagggtactcgcaggccgatgtggggatcgctgtgggagctctgtttgggaaggtgcttagccagacgaccatctgccgcttcgaggcccagcagctaagcgtcgccaacatgtggaagctgcgaccactgctgaaaaagtggctgaaggaagtggaagcagagaaccttctgggcttatgcaaaatggagatgatcctgcaacagtctgggaagtggagacgggcaagcagagagcgacgaatcggaaacagcctggagaaattcttccagcggtgccctaagcccacaccccagcaaatcagccacattgctgggtgcctccagctgcagaaggatgtggttcgagtttggttctataaccgcagcaagatgggcagtcgaccaaccaatgatgcttcccca

SEQ ID NO: 388433 - DNA, 407 bp, Homo sapiens
tgggaacaatgacattgtcttggagaattggcctctgcagctgacctgcagcagtccaccaggatgcttgtttaaacagtgaacgcagaagaagtgatgaccggccgctaaactttgaagtattgagttccaggcctggaaagcgtatgcagatcaggttgttttactttgctttttaataaggctgaagagcagatacacaagtcagttttctttggaaaggcaagcaatgaccctggagtagagaagatccacagggtgctgctgtgccagggtgaatgaatggcctgattgtccacagtgaccgatggcatgagaagggtccaaccagagctgtcacactctgggataatacaggcccactgttggtcctttaagattatgtttagagatccagccagcagcat

SEQ ID NO: 388434 - DNA, 472 bp, Homo sapiens
tttttttccacacagagtttcgctcttgtcacccaggctgcagtgaaatggcacaatctcagctcactgcaacatccacttcctgggttcaagtgattctcctgcctcagcctcctgagtagctggaattacaagtgtgcgccaccatgcccagctaatttttgtatttttagtagagacggggtttcatcacgttggccaggctggtctcgaattcctgacttcaggtgatctgcccgccttggcctcccaaagtgctgggattacaggcatgagccactgtgcctggccaatgatttttaaaagtatttttttaatgaatgatgttttaaaaaataatgagattatagctattgtggtaaggccaccagtaccagctctgtagaaggtctctcaaataatatttactggttgcattaatgaatgacaatcagtggccacgtactagagatcagagaatttttctgtatta

SEQ ID NO: 388435 - DNA, 467 bp, Homo sapiens
ctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatataacatattagttcatttgtatttaagatctatcttgtttacgcctcagtttagttattgctcttacctttcaaacagttaatattttgtatctagttctgtgaaagcaaaaagcaactttattctttcttacaattccccttttacttaatcggaacatttctttcctgtttgttcattagtcactctcagataaatgaatagtctctttttctaaaaaaaaaaaataacatttgacctaaa

SEQ ID NO: 388436 - DNA, 279 bp, Homo sapiens
cagtgacccctgtgcctgggagcattttgtgtatggaaggggacacagttttcactctcatgtccctattggcctgtcccaggctggcggcagctgatcagaccagggccagatctgatggttgcaatggaggaggagaggagaaggaggtagtgacccatgggttaaaggggggaggcccccaggtgtgtcaggatgcagccctgccacaaagcgtggggtcagcccaatcctaactcaactctacttgctgtgtgaccctgcacaagtcacatcccc

SEQ ID NO: 388437 - DNA, 806 bp, Homo sapiens
ctaagtttgaggagactgtaggcatctaagtagtggtgctgaggagggagatagatgtggtgaatctggagaaaactgacctggaggtgaaatgttgggcatcatgagcttttactggtatttactggtatttgttgttgtttttcaatgaagaacgttacattatttcttttctcatagttggaactagtctttacagctatttagaggattttcagggtgatggctgttcttagtagtttgagacccatccctatcctttgtgcgtttcctaccagccaaattcaaactttcacgtttggccaacaaaggaagccttttgcaggacagaggggacagaatggtgaggaccttggcaggtgagagccctgtgtgggcagcacggcctgcctagtccatctctaaaatcagatacacatacgttcatattccagctccataaatggtattttaagctgggaggctggatgagatcataaagaaatgagaataggtaaagaggatcagagacggagcctggggcctccaacatttacagtgaggcggtgaggaggaaccaagccaggagcctgggcaggagcagcccacaacataggaagaaactaaagaggatggcatcctggaaataaatgatgaaagcatttcaggtatgatagagagactaacagagccaagtgctgctgatgtgtcaaggaagatgagggctgaaaatccactattatatttagcaatacaaggtcattggtaattttcactaaagcagtttctatggagtgtttgggtgtgaaagcctaactggagagggt

SEQ ID NO: 388438 - DNA, 761 bp, Homo sapiens
ttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagctgctcagctgatttcacagaggggtgacaagggaggacaacagacacttcaaaaggcaagaagaggatggcaggagctcttttgccatggctaccaggccgatctccgagcggaaccaggatgccactgtgtacgtggggggcctgaatgagaagttgcagcaattgaagccatgaatgggcagtacctctgtaaccaccctatcaccgtatcttatgccttcgagaaggactccaagggtgagcgccatggcttagcagctggacgacttctggcagctcagaacccgctctcccagcctgaccgccctcatcagctgtttgcagatgcacctccttcaccctctgcccccaatcctgt

SEQ ID NO: 388439 - DNA, 125 bp, Homo sapiens
tcatgctccgctctggacatgggtcatttccaaaggcactgcttctaagtcacatcctcttaccttcccgctgaaggcataaggataagaaagtactagatatacttttgaattgaaatatggta

SEQ ID NO: 388440 - DNA, 301 bp, Homo sapiens
aagtctttagcacttgaagaaatgggacatcttaattttagcttctgatcacagtttataaactataaaacaaatttctttttaaagtcttataggaacaagaagtgatcttgactaagattcccctgagatagcctcgcaagtgaacagataataagatcacaaaaatgtgtttgcctgtgatctttagatggccacacacagcacacagtctactttcaggtaattttcaagtaaaaatctcagtgtaatcataatgtattgatttgttttgccttggttccttttcacaaatatattg

SEQ ID NO: 388441 - DNA, 376 bp, Homo sapiens
tggctagagagtaggggaggagacatgggagtgaatattggtgagggtaaagagagatgttcacaacagacactttgctccttggacattgacatcctagggactgttgcctgtttagaaaggcgttgctgccacatggcggttcttgggtgacctcggcatatgagcaggggaaggtctgaaacagtgggaggctcttatttcggagagttgagcacagaatgttggagtcctttttgattgcaaagtcacccacaaaggcatgtgtgtccctgcagcttgggctacagatgggcagtgaagcatgcgcgcacgcacacacacacgcgcacactctgagagactgacttcagatgagcttttattagctaacata

SEQ ID NO: 388442 - DNA, 437 bp, Homo sapiens
gcttactatatttagagagatgagataacttaaacagcaaactttaaaaagcatatcagaattccacatgcaaaacacagtagctaaaataggaactcaataggtttaacagtgggaagataggtcaggaaacaaatacgcatattgagggacagagacattaaggatagacaatgcattggtaaacctaactgaaaatataattattgcaggagcgaatggggcaataatcgagattgatgactttgcagaactgttaataaagtgttaactttaagcatgacaaaaataaccagttaaagatattaagactaggcactgcagcttaattagtgtaatcctagcactttgggaggcagaggtgggaggattgcttgagcccaggagttcaaggctgcacttcagcctgcataacagagccaagacgtctttaaaaa

SEQ ID NO: 388443 - DNA, 834 bp, Homo sapiens
ccactgcactccagcctgggccagtgagactatgtctcaaaaaaaaacttagtaaatgcttgtggcttaccattatacataagcctatgtttgcaagacagtgtaccttaaacaaagaccaggaatactgtcatttcctggacccaggaaaattggccaggcgcagttgcacgcgcttgtagtcccagatattctggaggctaaggcagaagaatcacttgagccctggagttcagggctatagtgcgctatgttgatctggtgttcatgctaagttccgcatcaatatggtgacttcttgggagtgggggaccaccaggttgcctaaggaggggtgaacctgcctacgttggaaatagagctggtcaaaactcctgtgctcatcagtagtagaattgcacctgtgaatagccaccgccctccagcatgggcaacatagcaagaccctgcctcttaagataaaaattggaaaacactggtaggaaaaaaaggctgtttggtctaaataagtctggattgggtataaatgacacaaaactatcatgaatttgaaagcatttctaatttcttgaaagtctgaaaaagtttaaacagaattttagctgaaaagtcctgaaagacatttgaaaaaaaacagcaagaacacttaaaactattcaaggtttgggctgggcacagtggctcatgcctgtaatcccagcactttgggaggccaaggcaggcagatcacttgaggccaggagctcaagaccagcctggccaacatggcgaaaccccttctctattaaaaatacaaaaattagccaggcatgatggtgcgtgcctgtagtccca

SEQ ID NO: 388444 - DNA, 1187 bp, Homo sapiens
agtaaaggctgtgggcaaacacagtgcagatgccacaaaaccaggcccactggggttggggatttctcctgccatccacacactcctgtctctgcaccctttttgcaggtgagggagggtgcttttgcccttcataggtccttcatctttaagaaatatgtacactcccaccctccatctcccttggtgctctctgataactgctgctgctggtatcgccctcctttgcttctctgcctcctccttgtctcttgtgtgaactggatcttctttggaagtccttgcaactcttttggagtttgtctcccggttttgctgaaaatgaggtttttgttttctcttcttgttttgtttggatggttccaggaggaaaaggggagaatgctgagctcatgcagccgagttcgtactgagagtctcagcatttcttccctgcccctccccgctgctcttcatgtgtgtgactgtgctccctgggtccttctcttctgggtacactcatattttgtcagtttactctaagtgaattacccagattcagaaaaggataattttcttcctccctcaaaaaggtgttttgttttggagacagggttttgctgtgtcacccaggctggagtgcagtggtgcaatctcagctcactgcaccctctgccacctgggctcaagtgatcctcctggctctacctctctagtagctgggtctacaggcatgcaccagcatactaggctaatttttgtattttttgttttgtagagatggggtttcaccattgttggccaggcttgtttctaactcctgggctcaagcaatccacccgcctcagcctcccaaagtgctggaattacaggcatgagccactgtgcccagccaaaaagttttaatactacttttcctatttagagcatcatcacatctttggctcatacaagactttgggtctagttaaatttttttttgcattttgttcacaagccaaccttttcttccatctagtatttatttgctttttaggaaaaatgaagcttacttaattgtggtgtcattttatctcaatagttttgtgctctttttttttttttaaattgaatcatggtttggcatcgtttatctgttcctctgtactttcatgacactcacacatttggttagcatgttttctttgttctttgtctaagtttaataa

SEQ ID NO: 388445 - DNA, 595 bp, Homo sapiens
tcataatagccattctaacaggtgtgagttaaagggtctgtagtactcttgcagtgtctttgctgatattctgtgtttgttttcctgttctttatttcatttatttccactctagtctttattatttcttcattatttaggagtgttatttaatttccatatatttgtgatttttcctttctttttttggtctgtattgagttctacttttattccattgtggttggaaaacacactttgacttaatcattttaaatttattgaggttcattttatagcctaacatattgcctgctggaggatgttccatatatccttaagtatgtacattctggccaggcacggtggctcacgcctgtaatcccagcagtttgggaggccgaggtgggcagatcacgaggtcaagagatcgagaccatcctggccaacatgtgtgaaaccccatctttactaaaaatataaaagttagctgggcatggtggcgcacgcctttagtcccagctacttgggaggctgaggcaggagaatcgcttgaatccaggaagtggaggttgcagtgaggtgagattgtgcctggtgacggagtgagattctg

SEQ ID NO: 388446 - DNA, 367 bp, Homo sapiens
tgagctttattgtgtgatctctgtgacatctatttctgttacataatggtctcatttcttctgtattgttttgctgtattcataatagtggaatttgactgacagaggatctccagataaggaaaatgctgttaaatacacaatctttaattagcagatgattttgtcaataatttgaaagcttccctcttccatactccccaaatctctgaatatactttagaaaatgaagatcctaaaacatatttcaacattttgaaaaataaaataattgaagtaattcccaactgtcttaaatataaatcaaagtatgggttatttaatacccaagaatgaaaaataacatcagagaagaaaaggtaaatat

SEQ ID NO: 388447 - DNA, 352 bp, Homo sapiens
ttattaaagtttaggaagcacagggatagtcatcccctacctaggcaatgaggttttgttaatccttccatagaggtgccaattatgggaggaaaatggtagtgagtaggagattgtggttgataatgatgtaccctacaggattacagtgtgggggcaaatgagagagagtcataaatacagagtctgagtgaaccaaaatgagccttggagggagtaaatcttactgtagacaagcatcaagtttaccaaccagcacagatcctacaatcttgcaaggatgcaagaattttcttaaatgggttaacaagtaacttcagttcaaaaaattccaacattcaaagtttctgtc

SEQ ID NO: 388448 - DNA, 395 bp, Homo sapiens
aacttttgaatgctatacctttccaattcactacttattctcaaacaaataaccttaaataaatacagtaaataattcagtctctttttctacacaatcttccagacctcaataaacaaagataattctgcttaaataaccacttaaaatgtacatttcctttgacccacagatcccacgtccaggaacaatttttacccagaaatattgtacatgtacacagataaagatacacagaaaatctaaattaaattggaagccaatctatgagtccatcaagaggggaatgtttaaataatttatagggaaccgatactatgaaatactatgttattattaaaaagaatgaagtacaatgtatctgttattgttattgaatgacttctaagtcatat

SEQ ID NO: 388449 - DNA, 606 bp, Homo sapiens
tcagaaaaggccttgtcccttccaggaataagaagggactttattatagatgcagtaataaaaacagctgccattaagtgagcacttactaagtgtcaggctttttgctaggcactgatatccattatctcctgtctacacaaagcattcttgttcccattccaaagacgagcaatatgaggctcagaaagattaacatgcccaaggtcacacaggtaaatgatggggtcagaatctgaactctaggtctgtcttgggagggaggggaaaaaatcagaacaaataaggaggacacagggagaatagactcaggaatatgaaatacaacacacaccaccgaaggacagttcacatgtctttacacagggggtataaaatatgtatgcaaagctgaattctgagtcagaatgacccaactcgtgcttgaaagcaagtgcctcttaatttgcccctcatggcagcctgtgagacagtggtgtcctaactcctggcctttgaggaagtcaaattcaccaagtttccatgagccctccacagccacacccttctcaaatcaggcaagctcatttctcttgaccctcccctggtgtcactgaggggacaggt

SEQ ID NO: 388450 - DNA, 1762 bp, Homo sapiens
gtcagattcaacattatgcaagattattgtataggagcaattgccaatgatttgaaataaaaaccatggaagaaaaatcaacattactgttctattaagctgtttctcccccctaggagttaagaaaagacctctcactattctagcagtatagcatatttgttcaattccagaaagatgggaacttagtctaaaaatgactctttgagcaactcatatttttctggaactctatgtaaaagcaaattaatataaatatatatgttttgagatactgggacatcacacttttttttaatctttcagttgaatttcttcccaaatagagaatatttttattctttgattcttctagcctatctgtattttatgatcagattttgctaaaacagacctgaagatgcacctggataattaggtaattgagtataatttggaaagtcagtgcttatataaaccatgcttaataatggactattttgattctgtcttgaccctagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacagaatgaaaagagaagaaaaactatttagagaaaggtttaagtacgacaaagagattattgtcatcaatacagcagtggcctgttccaataattcaagaaatggaatatttgatttgccaataagtcctggagaagaattggaagtcattgataccaccgaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctgacatcta

SEQ ID NO: 388451 - DNA, 1794 bp, Homo sapiens
  misc_feature (1752)..(1752): n is a, c, g, or t
  misc_feature (1761)..(1761): n is a, c, g, or t
gtcagattcaacattatgcaagattattgtataggagcaattgccaatgatttgaaataaaaaccatggaagaaaaatcaacattactgttctattaagctgtttctcccccctaggagttaagaaaagacctctcactattctagcagtatagcatatttgttcaattccagaaagatgggaacttagtctaaaaatgactctttgagcaactcatatttttctggaactctatgtaaaagcaaattaatataaatatatatgttttgagatactgggacatcacacttttttttaatctttcagttgaatttcttcccaaatagagaatatttttattctttgattcttctagcctatctgtattttatgatcagattttgctaaaacagacctgaagatgcacctggataattaggtaattgagtataatttggaaagtcagtgcttatataaaccatgcttaataatggactattttgattctgtcttgaccctagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacagaatgaaaagagaagaaaaactatttagagaaaggtttaagtacgacaaagagattattgtcatcaatacagcagtggcctgttccaataattcaagaaatggaatatttgatttgccaataagtcctggagaagaattggaagtcattgataccaccgaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaatatgatgcgnccacgcccntttttttttcattataccgtgattattatatat

SEQ ID NO: 388452 - DNA, 906 bp, Homo sapiens
tagtgaatcctgatagggagataagcagaaagggatataggcaaataggaatgtgctcattgaacatctagattcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctgacatcta

SEQ ID NO: 388453 - DNA, 1599 bp, Homo sapiens
gtcagattcaacattatgcaagattattgtataggagcaattgccaatgatttgaaataaaaaccatggaagaaaaatcaacattactgttctattaagctgtttctcccccctaggagttaagaaaagacctctcactattctagcagtatagcatatttgttcaattccagaaagatgggaacttagtctaaaaatgactctttgagcaactcatatttttctggaactctatgtaaaagcaaattaatataaatatatatgttttgagatactgggacatcacacttttttttaatctttcagttgaatttcttcccaaatagagaatatttttattctttgattcttctagcctatctgtattttatgatcagattttgctaaaacagacctgaagatgcacctggataattaggtaattgagtataatttggaaagtcagtgcttatataaaccatgcttaataatggactattttgattctgtcttgaccctagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctgacatcta

SEQ ID NO: 388454 - DNA, 410 bp, Homo sapiens
actgaggctcataaaggagatgaaatgtgattataagcaggctgatctcttgcatctggattcaaatttggattaccacacatcaggggtcagcaaactatggcctgaggaccaaatatggcctgccacttgtttctgtgtataaagttgcaacagtagagttgaagagctgccatagagataatatggcctgcaaagcctaaaatatttattatatggcctttccatggattatcaaaatatatttctagatgactttttaattttttgtaaaacataattgcccatgaagtgttgatggttccatgaatatataattcagtcttaatttacttgctcaaaatatatttctcctcagagatgaagataaactgaaaatgtggaagcccaagtttctgacaccaaaggaa

SEQ ID NO: 388455 - DNA, 237 bp, Homo sapiens
tagaatgtccctcaatttgggttggtctgatgtttctcatgatttgatttcaggttgtgcatctttgtcaggaacctcccagaagtgatgccggctcttctcagtgcatctgctctcgtagacctggctccgtgtgtcccattactgcttcccttggacaacttggtggagcttctccactgtaaaatgacttttccctttgaaaagagatattttgttggcagttgggcattttga

SEQ ID NO: 388456 - DNA, 563 bp, Homo sapiens
gaccacaagagagggttcttggatctcatgcaagaaagattcagggcgagtcgcagtgcaaagtataagcaagtttattaagaaagtaaagtggtgaaacaacagctgctccatagacagagtaggatgttccccaaagtaagaggaggggctaggcgcagtggctcaccacacctgtaatcccagcattttgggaggcctaggcaggtggatcacctgaggtcaggagttcgagaccagcctggccaacacggtgaaaccccgtctctactaaaaatacaaaaatagctgggactacaggcacgcaccactacgcccagctaatttttgtgtttttagtagagatggggtttcaccatattggccaggatggtctccatctattgacctcgtgatccgccccctcagccttccaaagtgctgggattacaggcgtgagccactgtgcccggcaaaactctgtctcaaaaaaaaaaagtaagaggaggaacacattcaccctcggtataatgcttgtatatatggagagatgtgctctgctacaaaagtttgtgataaaggat

SEQ ID NO: 388457 - DNA, 607 bp, Homo sapiens
atgataaaattggttatgttacacatcatttcacttaaagatgaagttttcaagagtgtatctatgatgacattaaataaagacttactgtgatcattaaatagtgactccacattattgcttctcccagcctctggtaactacagttgactgctgaacaacatgggtttcaatccatttatatgtatattttttcattaaatacagtggaaaattttggggaaagcttcaacaatttgaaaaacctcatagatgaaccatatatcctggaaatatcaaaaaactctaaaatttagatatgtcatgaatgtataaaacatatgtggtaactcatctattttatcatttactaccaaaaaatatacacaaatctattataaaaagttaaaacgtattaaaacttaggcacacaaacacagactatatacggtgttattcctagttgagagaaatgtaaataaacacaaagatgcagtgttaaataataactgcataaaattaactgtagtacgtattgtactactgtgataatatcatagccacctcctgttgctattgcagtgagcccaaatgttgtatctgctgaaaacgctatgtgatgcaaatc

SEQ ID NO: 388458 - DNA, 381 bp, Homo sapiens
accttgaatgttggctcctggaaatccaattaaatatggaaagtgtttggctgaagtgaaatgcaaattactacccccctccaaccccaagtgtccctttagaaagcagagtccagaggagcctataaggtgggggtcaagaggtgtaggtttgttcctaggtctgtcactggtaatctgtgtggtcttcaataagccccttcctttctttgggtctttttcctgctttggaatgttatgctcaaggagcttctcccttttagccccctgatgctaggaggccaggccatgggccatgccctgtgagggaccctgtgtgcagaggagcaggagtgagggaagctgttgtggttacaagcgcattattaacctgtatgagtg

SEQ ID NO: 388459 - DNA, 341 bp, Homo sapiens
tttgatgcctgtccaatcccgcgcactccagaaacccataatacgggagacaatgaagccaagagtcgagtctttgggcactttggacgttctactctggcagagtcagctgggggactccaacggccaaaggtccacctgctcctcaccgtctgctcttcactgcttcctccgcctgctcttcaccgtctcaaaagtcgccggcccctctacaggcgacaactgcagcttctcaggcgaaagtcactctctttcccattcttagccccgctcacaccttgcactcacagtcatttctgccaggcctgggccagcagacgcgcgcgtgggaaggaccagaa

SEQ ID NO: 388460 - DNA, 352 bp, Homo sapiens
aacatctccagcttagacacagtctcgttcctaactgccagttctcagccacaatggctcaaagaagccgaaggctctggatggaagaaaattgctttccacaggcaaaaatggaagatatctgcacacactgcaagtgcacagacatcagaagagagcactgcattccacatggcatccatctggtatgaaaccccgcattttttaataaacgagaagcctgttccatatatagggagactcctgaaaacctggtgatacatatatttgaaaatgagggtgtttccataggaatgaaagaaactgtctgtttatagagcctgttacaacagaatagaccgattatacctac

SEQ ID NO: 388461 - DNA, 449 bp, Homo sapiens
aggtacctaacatttgagtgtctatggcaggcagtatgctgggtgctttcttttccttatagatagaatttaatcctcatatttgtgtcgtataaggaattgtgatcattttacagaagaagaaactgaagcaactgaggcatatagtgattaactagtttgcatttgtttacatagctagtaagagaagaaaagctcgtatttaaaaacctgatctgccttgctccagagccattgttctttttgttgtactgcatataaatcttcctggttttaagctgttaaatcagtagtcttctttttttttttgagacagagtctcgctttgtctcccggcctggagtacagtggcacgatctctgctcactgcaaactcttcctcccaggttcaagtgattcttctaccttagcctcttgagtagctaggaccacaggcccgtgccaccatg

SEQ ID NO: 388462 - DNA, 345 bp, Homo sapiens
tctttgggcaaagcagaacaccatctaacaccagaggactagactgcggccggagcattgcccgagccatcccaggggatggagatggggaaatggaggcccagaaagaaaaggagactttcctaaggtcacatactggagctcgtggtgcagctagactgcaacctaatgtggtggagttcctactaatatctggattcatcattcaagtcactttgatgttctctgttctttgagctactggagaatgccttgtttgtctttccaattcatagagacacagacttgatggagatttgaaattcaacaattgtggattacattttaaagcattttttcctaatt

SEQ ID NO: 388463 - DNA, 2148 bp, Homo sapiens
ccagctctaggcaacatagtgagaccctgtctctaccaaaaagaagaaaaaagaaatcaacaacatgcaaccataagaatggatgagatggccctaaaagaataaggattacatataatgagaagacgtgtgggctgaaatacctagtgaacaatatttaagggaaactgaagtgcaaatggcctcacaggtttgtttttgtgtttaagacaaggtctcactctgttgcctggactggagtacatagcacgaacatggtttactgcacctcagcttcctgggcacaagtgattctcccacctcagcctcccgagtagctgggagtggtggcacatgcctgtagtcccagctgtgtgggaggctgaggcaggggaattgcttgaacctgggaggtggaggttgcagtgacccaagattgcatgcaccactgcactccagcctgggtgacaaagcgagaccctgtctcaaaaaaaacaaggactctacagatagatagacatcatatatcatattagtttgaatcctggctgttagctgttagacttgggcaaataatttaacctcaactttccctatctataaaatgggaattaaaatatttgcaccttatagggttattgtgaggattaaataggaacattgtataaagcacttaaaacagtacctgggacatactaagtaatataattgttaactcttactagcattctgtcccttttatttcctaaatatctctcatgcccatctcctaaatatctctttcctaaatatctctcatgcttttggcttaagacctcttttcctccttatctattgactggactgcggcaaatgcctgctaatcgttatttttgtgttcattcatttagcaagccaatttattacgcgcttagggtgctgccagggctacaaaagctgttgagactgtacttgatatgaagaagcttgctgattatcatgggaagactgacataaggaagcaccataaaattctgctgtatgagaggtatacacgggatactgggggttaataattgagggtatggtccattcaacatgagtgagacagaaacaattcataaaggagatgaaatgtcttgaggaatgagctcttagaagaatagttttcaaatgagtgtgcatcacagtcacctgtaagacttattaaaacagatcgctgggccctacacccagaggctgtggttcagtaggctgtagtaaaccagtaatttgtatttctatgacgttcccaggttctaatgctgttccccaaggccacaccttggaaaccaccacattaaaatacccagaaggcattaattcccagtccttcctctacacagctgcaaaacaatggtcctgaccatttcatctttgcactacatccttcactgtctctcttttgcccataggataagtacaaactagatctggttactgcctgccccaccagcctcagcatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaaggactccaggaagtcttccctggacaagtaatgaagagggcataatccaagggccaactcccatgtttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgttcacaaacagcccttaatgtcaaactgaatactgccaacgtagttccagtttctgtatctaaagactcagcttggagtcacttgtctggactaaaagtaacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatcagattttttgcc

SEQ ID NO: 388464 - DNA, 2190 bp, Homo sapiens
ccagctctaggcaacatagtgagaccctgtctctaccaaaaagaagaaaaaagaaatcaacaacatgcaaccataagaatggatgagatggccctaaaagaataaggattacatataatgagaagacgtgtgggctgaaatacctagtgaacaatatttaagggaaactgaagtgcaaatggcctcacaggtttgtttttgtgtttaagacaaggtctcactctgttgcctggactggagtacatagcacgaacatggtttactgcacctcagcttcctgggcacaagtgattctcccacctcagcctcccgagtagctgggagtataggtgtgtgccaccacgtccagctaatttttttatttccttgtggagatggggtctcatgaccttgtccaggatgatctcaaactcctgggctcaagcaatcctgtgttggcctcctaaactgctgagattattgcaagtgcctccttgcccacctgggtgacaaagcgagaccctgtctcaaaaaaaacaaggactctacagatagatagacatcatatatcatattagtttgaatcctggctgttagctgttagacttgggcaaataatttaacctcaactttccctatctataaaatgggaattaaaatatttgcaccttatagggttattgtgaggattaaataggaacattgtataaagcacttaaaacagtacctgggacatactaagtaatataattgttaactcttactagcattctgtcccttttatttcctaaatatctctcatgcccatctcctaaatatctctttcctaaatatctctcatgcttttggcttaagacctcttttcctccttatctattgactggactgcggcaaatgcctgctaatcgttatttttgtgttcattcatttagcaagccaatttattacgcgcttagggtgctgccagggctacaaaagctgttgagactgtacttgatatgaagaagcttgctgattatcatgggaagactgacataaggaagcaccataaaattctgctgtatgagaggtatacacgggatactgggggttaataattgagggtatggtccattcaacatgagtgagacagaaacaattcataaaggagatgaaatgtcttgaggaatgagctcttagaagaatagttttcaaatgagtgtgcatcacagtcacctgtaagacttattaaaacagatcgctgggccctacacccagaggctgtggttcagtaggctgtagtaaaccagtaatttgtatttctatgacgttcccaggttctaatgctgttccccaaggccacaccttggaaaccaccacattaaaatacccagaaggcattaattcccagtccttcctctacacagctgcaaaacaatggtcctgaccatttcatctttgcactacatccttcactgtctctcttttgcccataggataagtacaaactagatctggttactgcctgccccaccagcctcagcatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaaggactccaggaagtcttccctggacaagtaatgaagagggcataatccaagggccaactcccatgtttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgttcacaaacagcccttaatgtcaaactgaatactgccaacgtagttccagtttctgtatctaaagactcagcttggagtcacttgtctggactaaaagtaacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatcagattttttgcc

SEQ ID NO: 388465 - DNA, 816 bp, Homo sapiens
gtggcgcaatatcggctcactgcaacctctgcctcccgggttctagctattctcctgcctcagcctcccaagtagctgtgattacaggcgtgtgccaccatgcccagctaatttttgtatttttagtagagatggagttttgccatgttggccaggctggtttcaaactcctgatcttaggtgatacacccgcctcggcctcccaaagtgctgggattacaggcgtgagccacgtcccccagccagtttcttaatctatacatctagcccagtccatgcccctgtttcagactattatatccaaccacctgctatacatctcataaaggtatctcaaacacagcatatctaaagctgaagtcatcatcttgccctggtttttcctgtctctttgctgatggcatcccatttacccagtcattcaaactggaaatctaaaagcctcacttagcaagagtttggaggcagaatatgataaagaacaaggactctgggaggccaaggcaggtggattgcttgaggtcaagagttcgagaccagtctggccaacatggcgaaaccccgtctttgctaaaaaaacacaaagaaattagctagacgtggtggcacatgcctgtagtcccagctgtgtgggaggctgaggcaggggaattgcttgaacctgggaggtggaggttgcagtgacccaagattgcatgcaccactgcactccagcctgggtgacaaagcgagaccctgtctcaaaaaaaacaaggactctacagatagatagacatcatatatcatattagtttgaatcctggctgttagctgtta

SEQ ID NO: 388466 - DNA, 478 bp, Homo sapiens
caaatcttccagggctccgggtcctgatttgcaggtgagcccgggagccaagatgtgaatctcaaagcccgtccccagccctcactcttagacaccgccctgtgctgcgaagggcagggccatgccaaagttcaatagcacctaggtagagggaagactttctggaagagacacacccctaagcaaaattttagaaaggacgtattctagcctggcaaatgtcaagagggaagaaaaaggaaacggcggctgtgtccatctcacaagtagctggtattgtgtcagaatctttacctacgctcttgtttaagcctgaagacgtgagttaggtataatgactcccatttgacagatgagaaaactgaggccacaccgtaatcgaagattcgagtcagtttatggaaggaccaacctcctgacactcatccccatattctgttcagggcttcacttagcaagccagcaaggcagggagagt

SEQ ID NO: 388467 - DNA, 322 bp, Homo sapiens
accagcagtaatccaagacatggaattagagatgacattttttctacttttattttgaaagactccctattttttgcctgaagaagagaaataggcaaagaaatatggataattatgaaagtagtgaagccacatctgattcctttgagatatttttcaagaacatttaatccttttaagcaatgttactcttgtcttattgccaatgtcagtgatagcttggataatcctctagctatgaactaactgtttaaatgtgacctggcaagtaacatactcattctgtactctaacttaatattgcaacgtttgtcattcatag

SEQ ID NO: 388468 - DNA, 348 bp, Homo sapiens
ttagtttttaagtctttttacccctcttctgaagagtctatagaagaagcctctgtttggtctggaaaccggggtatgtatgttcttgtctagatctaatggcaaagcttcctcactttcacttttgttgatgtctttgaaacacccagattcgatcatctgcatgcacagaataacaggacagagaagccgcagagaaactgccaggtcagtgggtgtctcccagtgccagcagctcctgcccagccccgtgcggggcacctcagagctcctgcacccactgtggggccccttttctgggttcctccttccctgcttcctgacctcttcttggaataagtaatgtgg

SEQ ID NO: 388469 - DNA, 449 bp, Homo sapiens
caaagtgctgcgattacaggcatgagccaccatgctcggaccatgccatttatgctgtacttacaagtttaattcctaaataacaattcttaacagcaagtgccttctggcaggctgtggactcccagcctgggttcatcctgaattcacctcttccacaaccttttattatgtgatgccataactctcgacactgcctttcccattaaattgagtttccttaagggaatgccccttgctgtttttgtctctgaaccaagcctagcatggtgcctggcatagagcaggctcttagtaaatacttaatgcatgactatgtgaagacataatagattttgttaaaagaaaaaaattccaaagcactcacagaaataaagcagagctgttaatttccccctcactccttgacaatggaaataactctcgtaaacacaaatgactgtgctatg

SEQ ID NO: 388470 - DNA, 246 bp, Homo sapiens
agatggagcctcactctctcgccagactggagtgcagtggcacgatctcagctcactgcaacctccacctccctggttcaagcgattctcctgcctcagcctcccgagtagctgggattacagatgccactgcgagaacgggaacaatggaacaggccctcaccaaatgccaaatgtgctatcaccttgattttggatttcccagcctccggaactgtgaggaataaatttttttacttataaatt

SEQ ID NO: 388471 - DNA, 373 bp, Homo sapiens
atgccttagaaatcctaccacctcccagaaatgatagttatggaaattaacatggcatgtcagatatggttcgctgatgccttgctttagttctcagaaataaggctttaaaagactggcatgtttcaggattgctgtcaggaaatgataatttaaaatacccaagagtacactaagaattatggaagcatctgtgaaactaataagccagtggacatactgatttttaccaatgtgtctacatactatattaaaaaacttcctacaaagtattgtcccaattcagttcatctgaggatgtgaaaacactacagtgtaccttaaaacatcacattcacaaccctgacagactgaaataaaaatgaaattaggg

SEQ ID NO: 388472 - DNA, 591 bp, Homo sapiens
cctccaaccttttattttgggctttttttactcaaagagagctcatgccatcaagcaaacagacagttaccatggttatactaacgctgctacttcacaacagataaccacaggttagaaatcttgttgctaggttgcaacatgctagctaagagtccatatctaaatgagaggctccctcaaaaacacacttccttggagagggacctggcgtttacattttagaaatttttttttgaagttcattttttccctctggtatacggagttcatcaatgctacaaactgcctttatccacctggataagactgagggacctcacagacaaatttcattttgtgatggataacgtgggagcaatcttcagctaaagtctagataaagccttaaagagaaaattgagctcggaagacctgaaaataaagaaaacaccctggcaccaacaagggagagaaacaaaacaaagaagctcaccaaagatggtttgactgtgcaaaaccatgggtacggtaaccagtaacacccttattttatcaagatgtctattgtaacaggatgtgttttcaataaatgtaaatgacctgtaaatg

SEQ ID NO: 388473 - DNA, 568 bp, Homo sapiens
  misc_feature (544)..(544): n is a, c, g, or t
  misc_feature (547)..(547): n is a, c, g, or t
  misc_feature (554)..(554): n is a, c, g, or t
  misc_feature (558)..(558): n is a, c, g, or t
  misc_feature (564)..(564): n is a, c, g, or t
cctccaaccttttattttgggctttttttactcaaagagagctcatgccatcaagcaaacagacagttaccatggttatactaacgctgctacttcacaacagataaccacaggttagaaatcttgttgctaggttgcaacatgctagctaagagtccatatctaaatgagaggctccctcaaaaacacacttccttggagagggacctggcgtttacattttagaaatttttttttgaagttcattttttccctctggtatacggagttcatcaatgctacaaactggtacgtattcatacacactgaatcacattccttactccagttgcaggcacttgatgtttaataactagtttatctcaagtcaggaagtttacagtgtcaaaatgaatcaaattgattttaccatttttatcaagtattctctgaatatgctctttaaaaaaaaagaatatatatatatgccaggtgcggtggctcaggcctgtaatcccagcactttgggaggcccaggcccaagatgagataccacaggcccaanatnagggtancganctcganttcg

SEQ ID NO: 388474 - DNA, 802 bp, Homo sapiens
atcacatttattctgtgattagtggaggacagagaagagggactggggagaaaaactgcctttattttaagaaagctcattttcctgtaactattcaaaaagaattgattatcaagtgttagataacaatattactaacatttatcatcattcaaatatttagtaaaatttctccatatatttaaaattttacttaagaattttcccagttaaaatatgactgcttagtttgaataaggaagacattcctttcaattcatgacacaatagtacatttttattcttttctcagacagcagagagacactgttactgctttcccttgtaagtcaacagtctgtgatacatgctgtacttttactgattagcaatgcaatgttactgtgaatatttaactagaacttattatattggaatttaaaattttctaacattgaatttagttctcttcatcaaataagcaagcattatttttatgaaatgaaataatcattcttaagcagtgatgataatggaattctgaatacgatgtaaaatcaaacattctattttttctgtttatcctttgacattgagttgttttaatttattacatattattaagttgaaataagctttataccatgttctctgatgttcttgtcataataattttgggtcttttgttaagtaaatatcagaaaatatctgtgagttttgattatgtgatattttcatctgattgattttttaaatttctcattggatttaaagtgttttctttgctaatgttatatacagaattcaataaaagaccaaaaaa

SEQ ID NO: 388475 - DNA, 695 bp, Homo sapiens
tgctgcggcacaggggcggtgcccttcagggaggcgcgcaggagcccatcttgggggagctggagcatggcgggctgcaggtcccagccctaccccatggggaggcggctgaggcccagcgagaattcgagcactgcgcacgagggacggcagtgctgggggaccgggcgccccctccgcagctgctggcctgggtgctaagcccctcactgcccggggctggcggcgacggagggcggctccgagtgagtgcggggcgcggagccccacgcccacccggaactcacgctggcccgcgaacgctgcgcgcagccccagttcccgcctgcgtctctgcctccacacctccacgtaagcagagggggccagctccaaccttggccagcccagagaggggcgtcccacagtgcagcggcgggctgaagggctcctcaagcctgaccagagcggacgccgaggccgaggaggcgctgagaaggagcgagggccgccagcacgttgtcacctctcaagagttcagaacgactacagccttgacattaaccctggaaatcagattctgtgctaaaatgggggtgaccaaggaacagatgtacaagtagagctgagatctccctatgttgcccaagctgttcttgaactcctgagatgaaacaattctcctgccttgacttcccaaagtgctgggattccag

SEQ ID NO: 388476 - DNA, 815 bp, Homo sapiens
accctggctattcacacgcttcagttcacaacttccatccagaatcctacttctctgattgtcctcatggggaaagtatgctatttccttcatcctacaagatgcttctcactgactctatccatattcttctcatccttcaagagccaagtcaaatctctctgcttccaataagccttccttgctacactcagaaatggaatgaatccccaagatggcttaaggatgcccttctgttttggaatgctttctcttggtgtatatcaaggttggttcagtttaccagagaaaagatgccagggtctcattctgtcacccaagctggagtccagtgacatggtcacagctcactgaagcctcaacctccttggctcaagcaatcctttcacctcagccttctaagtagctaggagcacagtgtcataacagaagaatattcgaagctctataaatatgttgcttctacgtggcaaaaaggactttacagcatctgacgctacactggattatctgcgctgggcacaactgtaactcacaaggggcttcctaaccaaggacacgaccgccggctcaacgcagcaacacccggaccgacctcataacatcggctcccaacgatggacgaccgcggacacaagctcaaggaatccaggtggcctctagaagcctgccaagtcacagacacgaactctcccctagcagcctcacgcaaggaccacagccctgctgacagcctgatcaaggattcctgacctccagactacgttgatgccccaaaccgacctgccactccaacttctatacctttccgaacg

SEQ ID NO: 388477 - DNA, 415 bp, Homo sapiens
gccaaattgtagtgcctggggttatttatcaagctgtcactgaacacctagggaagtgcagttccagctaatttattacaatgttgttttcatttttactgggcgcagaaggactcacattgaggccatcgagctgtgatctgcactggaacagacgcagtgacaatgctacttcacttgcacattttttatggcatgtatttttccctgactctgctattttctcataacatttaagaatgttcgttaagctcaaaagaagctaagcgctatttatataggtggaatgaagatggagaggggaaggtgagaaggttgaaacaaatgaatgctgccccaagaactacgcgcatgttacttgcaaatgtgacttgtttaaaccccgaatgtcttacatggggtgactctatcaacg

SEQ ID NO: 388478 - DNA, 276 bp, Homo sapiens
tcaattaattccggctagcaaatcaagaaagaatgaaaagaaaatgacagcttttgcagtttaaaagtgtgccatcaccctccactacatacacaggatgaatccaggtaaacagagcatccgcagaaagctagaaagagcagtagaggcccagggccagtatggagaagagagaactagggaagtgatgccaaattgtaaaggttccttaatagtcgctataacttcaagaaagtttcttccttgatttgctaatgaaatagttctgagtccagg

SEQ ID NO: 388479 - DNA, 3222 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccggggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggccaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388480 - DNA, 1677 bp, Homo sapiens
cttcttaaggtcttatctcaagaaggatccttgggcttggcattaaaaccactttgctgtccgtggaggtctgacaggacccaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggccaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388481 - DNA, 1820 bp, Homo sapiens
aatttttgtatttttagtagagacggggtttcgccatgttggccaggctgatcttgaactcctgacctcaagtgatccacccgcctcagcctcccaaagtgctgagattacaggtgtgagccaccgaacccggccagatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggccaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388482 - DNA, 2348 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtggccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388483 - DNA, 1769 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcccccttcttgctcctgctttcaccatgtgacatgcctgatcccccttcgccttttgccatggtcataagcttcctgaggcctccctggaagctgagcagatgccagcaccatgcttcctgtacatcctgcagaaccataagccaattaaacctttttaataataaaaaa

SEQ ID NO: 388484 - DNA, 2893 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggccaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388485 - DNA, 2797 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggccaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccct

SEQ ID NO: 388486 - DNA, 1864 bp, Homo sapiens
  misc_feature (174)..(174): n is a, c, g, or t
  misc_feature (183)..(183): n is a, c, g, or t
  misc_feature (186)..(186): n is a, c, g, or t
  misc_feature (208)..(208): n is a, c, g, or t
gccccctgccaccacgcctcctccgtctcccgcgtccggcccgtcccaactcggcccttccgggacacccgggggaaccctccgggctccagggacctctgagtgatcgcccgccccgccctattcgcagccgccgggcctggtcacgcgcagagccgcgccgcgggatcgggnccagcgccnggnggaggcgggacggggacggggncggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggctggtttcctcggtgcacgccgtgctggccaccggctcggggatcgtcatcattcgctcctgcgacgacgtgatcaccggcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtggccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgccagtaacgggatcctctagaccac

SEQ ID NO: 388487 - DNA, 285 bp, Homo sapiens
aatttcatccacagacttccacctctggcaattactaactggtaccagatctaccctcctctgccactgtaaacaatcagaaaactgagcaaaatattggaggcaaccattttcaggcaagggacaacaggcagtgcagaaccagagcacctgccggcagggaagcagctggtaaatatgtggatacatacaaaacagcagcttttcttttgtcctcttaatttccttaagatgcaagtggctatttaaaataataatattgcaaggtgaggtttacatacacac

SEQ ID NO: 388488 - DNA, 565 bp, Homo sapiens
  misc_feature (1)..(1): n is a, c, g, or t
  misc_feature (30)..(30): n is a, c, g, or t
  misc_feature (84)..(84): n is a, c, g, or t
  misc_feature (169)..(169): n is a, c, g, or t
  misc_feature (288)..(288): n is a, c, g, or t
  misc_feature (311)..(311): n is a, c, g, or t
  misc_feature (394)..(394): n is a, c, g, or t
nggttataccctgccagattatatggttanaccctgccaggttatatagttataccctgccaggttataaggctcaagcacttnaaaattgctaaatgagcacctatggtggatctttcccattcttccctgcagagccatcttctatccttctctaccctgttgcatnacaggaggaggacctgcatggactacatcaaggagctttcttgcgctctggcttccatttgggtttcagccaaattgagggtgggagggggtgcagcagcaggagactgaaaggagatnagaatatttattgccctggctcnccctccctaccagatcttgtgtcctttgaccaaaggctacagttcccatcagatagctctctccacaccaactttcctctctnaattctgataaccattcccctccctttgtcccttcaggcatagaaatggtgatgcctgttggtagccccaaattactttgtttgtttatttatttatttatttatttatttagaaacggtcttgctctgtcacccaggctggagtgcagtggcgtgatcacagtgcactgc

SEQ ID NO: 388489 - DNA, 471 bp, Homo sapiens
atttgagaccttaagcagattgctttaccacaataacctcagagaaaaatgaaaaggaatggagaagtttgtaaactatggaattttacaagtgctgcttggggatcatcaaagttaacctctctgatgtactaatatttccactaatggccgtggattcttctaaacaggttgagaggtttctctgttagccaggactcagtgacatagctatataatttgcatcttctgcttcagaggtgagaagcagcagctgcttcttttttttttttttttttttttaattcttgattcctaaatggccctagtcctcagtccaatggatgttaggcaaattctgctgctggcatatttttgcctttgccccactgaccttttgtccaaagcatcttctgagtttcaaaaaggacagagaactcagagtcctctgagtttccagacatgcttgtgtgactgttttcagccacctgt

SEQ ID NO: 388490 - DNA, 268 bp, Homo sapiens
attacatgttttgaggaagcgaaaggctgccactcaaacttaggtctagagattacagccaaactcagcctcatctacttgtaaggaaatcaagaggaatttggcttaggaaagctatgatttgatttgatttactgttaagtttttttttgtttgttttctgtctcaaaaaacaaaaattgtgtagtaatattttgtcaacataagattataagcacctgtatggttgtaaacatgtagtgggcaaggaatctattctcactttggt

SEQ ID NO: 388491 - DNA, 973 bp, Homo sapiens
agagcagactaatactgtaatgacacataaaagattgatagctataaggtcttaagttctgtttcttacttaaatgaccatgggagctgtatgcatctaataaatgtagtcagtgacactgcagacccagtgatgagtggagggtgcttttgagggtatttttcctctgtttagcagatggcatctggcactaggttacaagatgaaaaacagtctctgagagtgcagaatctggcagggcagacaggtaaaggagaggaatgtagttggatttgtattggaaagatcagtgcagcagcagagccctgaaggcagtaagaccgcaaaggtgcaagcaaccctccaaacaccattgctgacacagcatgacacacacagtccatgaggaacaaggtccttaagtgaccatttaggttttggtgcttatgtagaagtaagaattaacactttatatcatatatgagctactacattattacatgtatagcctcaaaggtagaagaatgatcttgtattctcatttatgcagaaatatacaattgagaatgacttgtcccctgttgaccttccataccactgaaagaccagtgtatttctccctcctctccagcagcacggagctgctaatagctctccattaatgcatgtttgctttatttcttacccacgtgcttttgttcctgctattctttctgcctccccttcctccaccctaagtagcccttttctgggtccccatgctcatgtgcgcatatctccatcattgtacagaatacagtgtagtagagattttatctctgtttattgccttagtttgtgagctctagcggacctctgagtagatgatgaggtcaggattatatcatattcatttttgtcaccctagcaccctgaactgccaggaggtgctaaactaaaggtcattggtttttttccataatgttaaaaaaaaaaaaaacttaaaaaattagta

SEQ ID NO: 388492 - DNA, 401 bp, Homo sapiens
  misc_feature (344)..(344): n is a, c, g, or t
cactggggaaaaggggtttctgcagtcaaggattcagtaagtgtagtttgcagaacagtattcatactctcaactgggtctggaatcctccagtcaagagatcctctaatttaccttctccaggaatataagcctgggactacttttttttgttttttcctcttcaggccccccggtggaatggtatctcctatggccctggattcttaggaaaatcatggcttcccaactggatgggcagcaggacttggggtgaagtaaatggtagactacccagggccgagtgacacagaacaagaacatgaatgtagtttaaacttttttcctactccaggagccatggngattccaatagggaagaggctggaggagtctcagttactagttccttctgtttcccc

SEQ ID NO: 388493 - DNA, 493 bp, Homo sapiens
aaacaagcgggttcagtactcagtgtgttccttatcccttgtagcatttgggataactattaaacactgcaaatataaagtggttttggttttgttttgttttgttttttttaattggtgatcattttaataatacagtccatgcataatgttagaataccaggagggaaggaaaatattaaatagtaaaaggtccaaggcatggtttcacttgcaatttaaggaaattttacctttctcatcaataatagaacagatttcaccaccctgacccattctaatcaccattttaatggccatactctttgctgtattctagtacagagaggtggggagccttttttgtagcaaaggctgtgacacattgtgaaatatcaaaaaggtgtcacgtataaagaccagcttaggctgggcatggtggctcacacctgtaatcacagtgctttggaaggctgaggcaggaggattgcttgaggccaggggtttgagacca

SEQ ID NO: 388494 - DNA, 588 bp, Homo sapiens
gtttttattatttagagatataattgatatactatagaattaatcgttttagagagtacaattgaatggtagatagagcggaaaccttaatatattcacaaggttgtgcaaccatcactactatctaactccagaacattttaatcacccaccaaagaaactctgtttcctttagcagtgcgctgccatgctcagctattttttgggagagaaggggtctccccatgttgtccacgctggtctcaaactcggttgcttaagcagtcctcccacttgagccgctgtgcccaggcctgagttactatatttataaaagttatttcatatgatagacaaatcattcaaaacataatgaggtaaactgccaaaagaaaccattttaccatatttgaaggcatttaatgtaaatgttgaatttaatttcatgtactggaatcagtctttttgcatatgtaattttcataccaaaaatctctcttcagttgactcctggaactctctcatgataaaataaaagtttcaaataatgtcggggtggtggctaacacctgtaatcccagcactgtgggagtccgaggcaggtggatc

SEQ ID NO: 388495 - DNA, 753 bp, Homo sapiens
  misc_feature (353)..(353): n is a, c, g, or t
  misc_feature (355)..(355): n is a, c, g, or t
aaccagaactagggagctggtggagaaggtggcggccgctggaaggaggcccgggaggtggctgaggggtccaggcggcgggacgactctggccttttgaagaccgggaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaacgatgacacaatacgcactggagacgagtctcaggaggaggacgaggaaaacgggcgaggacggaaacgggggaggagcgacggagaacagaggacggacgngngacaggacggaccaaaaacgatctgctacctgcgacagaacaacctgaggacacaagggctgtgacgaaagtcccaaggaagacagggcaggccttcagggcacatacccagggaaggaaaacacagcaaggatagaaggcccgcaagcggaacgatcaacagacagttccccattgaaatcaagatttgggaggaaacaccacggattttaaccctgagttcccccaagtgtcaaatgcgaacagttcagggcacaaatttttcccccgaaagaaaaacccccaaaaagaaaggggtagacacagggtcacacaagcgttattccctgtgtaccgaaatggggaggcgagatggccagaagaaaaccaggcactggaaggcctgttaaaaggaagaa

SEQ ID NO: 388496 - DNA, 279 bp, Homo sapiens
gcatttccttcctccaaggatggcagctgcactgtctgggcacgtgggcgccggctcgtccgtgcagtgtggtggaacgacgcacagccgtcctggtcctgcacggggtggcggcacacaccggagtctcagccgggcacgccggccagggcctccctcctgctgtgtgcaggtctcaggctgagtagggcagtggtgggacaaggccccaccgtccctgccagcagctgccccagcctggccctgcccaggccctcctggttgtggacaagggaaggg

SEQ ID NO: 388497 - DNA, 631 bp, Homo sapiens
caacagaaggatggggaaattagacaggttattattatcaagcttaagcctaggcagctggtttgaaattagcctgggaagtcacacaaaggaaaataagaccctattttctgggttgcttaggactctgcttcagtgatcaaatcttagctgcagagctcataagatgtgctgtatttaggcatggacatagaggcagtgtggtaggataattacctgtttaaataccttcttcctcaaatacagattaatctgggactagggcaaggatgaatctgcaagttcagctgtgggagacctggggctgacagaagaaatagaaatggagccagaggactgaaattccattgtagttctgttgtagttccctgtatcatcactatcaccacatccactgttagcaatttggttaagaaaaaaacagtatcttgagtgtacattgagcttttgattcaagatgctcaaaacctttttttttttttttgagacaaagcctcactatgtcacccaggctggagtgcagtggtgcgatctcagctcactgcaacctccgcctcccgggttcaagctaagtttccagccttagcccctggggaagctgggactacaggtgctggcccccacgcctggt

SEQ ID NO: 388498 - DNA, 3201 bp, Homo sapiens
agagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagcagctggaaggggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgtaaaaaaaaac

SEQ ID NO: 388499 - DNA, 2384 bp, Homo sapiens
agagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagaccca

SEQ ID NO: 388500 - DNA, 1003 bp, Homo sapiens
cctcgcatacggacgacgtgcatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctgggttttcagctggaaggggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgtaaaaaaaaac

SEQ ID NO: 388501 - DNA, 3256 bp, Homo sapiens
agagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctgggttttcagctggaaggggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgtaaaaaaaaac

SEQ ID NO: 388502 - DNA, 3912 bp, Homo sapiens
tcgtttttctttgcttttatttacgatcaggatacaagaattctacgctgctgccaaataaatgactagttaaaattaactaactgaatccttaacaaccattctaagaggcagatattattatcccactttatgcgtgagggcccagaaccctggcaagggcggcacactcagtacgctcttcaagcatctgggcacacccggtccactacagtcctacaaagtcggacgtgagcacgggcgaaggcgtcagccggggccacacgggagtcactgaccacagccaggcgagagccggctttccggtgccgccacattccgggcaccaggctccgggctcttcagagcatttggggcgggcgacggaggtcccgtccactctcgcttgggtgcagaagggcgcggcggtgccaggaagccgccttggaggctccaagattagctcactcagcgcggccaagcgcaggtgcgggggccctcgccgccaccctgcttatctggggacagtcccggaacccggtgacccggctccgccccaacccgcgccctcgtccacccgcagcagccaaggcctcttccccggccccgggagcccgcgccacgcccgtcgctcgcgcgttccagtccaggctacagcaggggctctccagcctgcattccatggccaacagcagtgcagctgcagaagcacttctggaagcctcctgacttgaactagaccttggacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctgggttttcagctggaaggggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgtaaaaaaaaac

SEQ ID NO: 388503 - DNA, 290 bp, Homo sapiens
gctcaggcaatctggacaacttaagagtggtttcatatggctaggcactgtggtcaacacctgaaatctcagcactttgggaggtcaagtcaggaggatcacttcagcctaggagtttgagaccagtttgggcaatagtgcaagacctaacctccacaaaaaatacgaaaattagccaaccatggtggcaccacctgtagtctagctactcaggaggctgaggcaggaggattgcttgagcccaggagtttgagaccagcctggacaacacaacaaaaccccatcgctac

SEQ ID NO: 388504 - DNA, 571 bp, Homo sapiens
ggtgcctggcacctgggaggtgctcagtaaatatttgttcatgcataaatgaatctgagacccactggcctctgggaagagcataggagagggggacaacagcatgaggaccatatgtttgccatcttgctgaaggaatttcagccaacataataagacatgaaaatggcattcgaggtgtattagacagacaaggggatgttagtgtttgcaggagacttggtctgcctcagtgatgtcagtcagcagtgattgtgattccccaggggacactcggcagcatctggagacattttagtttaaacttccccagtgatctgtgatgtacaggagacactttcggttgtcacactgggggaggaggctgcatgtcactggcatctgttgggtgacacctacaatgcacaggacaaccacaacaaataattcaggcccaaatgttgctggtgctgagggtgaggtcctagtgttagtaacaggaggaaaacccagcagtctggaggagagacctcttcccagggcagcccaggggccatcaggagggttcatctcatgcattagaggtcttggg

SEQ ID NO: 388505 - DNA, 349 bp, Homo sapiens
agagctgattatcttactgatgtgctagaatcttttagttatacagtaagtttttattgacctctatagtgtgaaagacatcaagaaaatgttgaattaccaatagggtgttctaattttaaaacaatgtattctgttcttaaatttttttccagaaaaattggaaaaataaagtttcagtgcttccataaggttaagttttaggcctataaggattcacttaagtggggtattttattcctccatgattacagatgaaggaggcatttctaatagtataatctccacctttatttggattctactttgatgagtcttgccaaaaatgtccctaaaattcatgttgtaa

SEQ ID NO: 388506 - DNA, 86 bp, Homo sapiens
ttcctaggacccctgcctcaggtgactgtcaaaccatggaagtgccttcttctcctgccaaacctactttgaccaccctttggtag

SEQ ID NO: 388507 - DNA, 148 bp, Homo sapiens
caattggcctatctttaaattcactgattcctctttcatcttctcaaatctgatactgattttttttctttttgagatgaagtcttgctctgctgcccaggctggagtgcagtggtaccatctcagctcactgcaacatccacttccc

SEQ ID NO: 388508 - DNA, 423 bp, Homo sapiens
acacactggacatatggaatatggtcacaaagagtggacggctctgtcttttctacttccagtctttctttggcgtcctttcagctctcaaggggtaggtcaaagcaaaactcttctgtaggatgaagtgaacgtcaccaactaacccaaacaaatagtgtggagatgagcaggtgcttcatcagcacatggtcaagacaaatagaggcagaaaagaacctcgactaagtttacctatgcattttttgtcaggttaaaaagagaatatgcaggccaggcctggtggctcacacttgtaatcccagcactttgggaggccaaggcaggcggatcacctgaagttgggagttcgagaccagtctgaccaacatggagaaaccccatctctcctaaaaatacaaaattagccaggtatgatggcac

SEQ ID NO: 388509 - DNA, 418 bp, Homo sapiens
gaatggattgacagtcatgggaatgtaccaggtatcatgggggcaggccctgctctaggttatggagccactgttgggtagtcctacccttctcacatccagatgcagattccgctggcaattccatctagtcctatgagacattccctggaaatgatgtgctcatcctcatcagctacgtgatgaatgaatccaggggtgtttgtctgtgaagtgtctgctatctcctgtgcttgatttactgacgtggatgttgttctcgaggtgtgggttgaagccatgaaaataaatgccttcaaggaaggtatgtaagcagactgcagtattggagggtactcacagttggtaagtagggcagggaagaggaatgagaaaaggtaagaaggagagagagaagtgagagaatgagagtgaggta

SEQ ID NO: 388510 - DNA, 386 bp, Homo sapiens
ctccatcctcccacctcccactgccatcatggaaatcatctctcacaaggccaaatagcccatctaatcctctagactttggcctgtagtgggttccataaggactccccttggtctttcacagcataggacaatcaggagcttgttgcaaatattcacttgggtggaagtcaagggaaagcaatgagaatatacatgaagggaacaattctcaagacaactggtgggcaaatggacgcaaacttagcccaagacatgaaagaataacaaatacctccaagattttggtcctggggaaatgaaggttgtgctataaaaagaacgtgaaaagttagatccagtttggatatcttgactttgagatgctgggacattcaaatagactg

SEQ ID NO: 388511 - DNA, 465 bp, Homo sapiens
taaaattagattgtcatcctggttgtccaactctgaatgtactggaaaccattgaagtatacattttaaatgggtgtgctaaatggtatatgaattatttctcaataagtgtgtttttttaaaaaagctattgattatttccatcagtctcattcctcttgacaaaaatctgagttgatggtgagcatgtacttcattcctgactccaaagggtacaatatttacaatatttgaatttgggagtgactttactattacaaccttccccttgaagacctggaagacccagcaacataaggacaaacagtagtctcagccttgtactaagacttcagcaaaaataagagagatgggagggactactattgggaaggaggggcaatatttctaggcaaatattgtggtagaatggataagagcttcggctcattgggcaaataaaccaagttttaaatcctgattcta

SEQ ID NO: 388512 - DNA, 876 bp, Homo sapiens
ttccctcaaaaccctaatatgagcttcgaaagatgcatgatttgaatatgtggagatgggaaattactgagcccgtagagtaaatatcacatgtggggctcagtcttaagtgaggttactggggcacctaccttatggacagaattcaaagcgatgccaaaaagcttattaatcaagttaaataatattttaatgaagtatttaaaaaagcaaactagtaaaaaaagataaaaaacatatcaaactttaaaaagacaagatccgtgacaatccttcaaatatttttagacaggtgtctgaaaacctctcagagcctctaaggcttctaagagcctctctttctgggttgaaatcttgctgtggtgtcaaatgtctcttataggacatggtatttagatctctcactactcttccattaattcattcaacaaattatttgttcattgtgtgtctactaagtgccatccagaatagtaattaaatatttgtcaaattaataaacaagcaaatatctaattacagtgtttttaaaaagacacccacaggggctgtctagtctagtagaaagaagaagcattaacaaagtggtgggtgtcagaagggcttggattggatggtaaaggatccttaaaataggtttgttatttattaagtcaataaataattatttagtatatactaatgcagggcattctacatatatcagttaagcatttcaaaatgctagtaggcaaaatgatttagagactcaaagtgtaaattgtcagtattttcaagagattaatttcatggaggaaggcctccttggtgaattactctaagagacaatgtttactggatacatgtcattgcattcctctagctgttattcctcta

SEQ ID NO: 388513 - DNA, 516 bp, Homo sapiens
tgggaagtggctccctgggcctcttgctggaaacttgggctgggctcaggccgggcaggaaagtcaccggttctgtcccgcctcagaaggagcctggggaggaggcgggggagctgctggatctggaagaggttatttaggacatgcagattgtctcctagggaggctgggggagagggtgggtgagctggcaccttcctccaccttgctctgtggcgggccaagtcttctgctgaccctgagaggagtctctgggccccatctcccagggaggagggcagcaagcaggctgctgtgattggctggcagggaagccagggtactggggcccccgactgctgtgagtcgaggaacaggattcctcttcctgccaagtagctcagagatgggagtaggaggccagagttgggaatccaggaggcgccacagctctttgtgatgaatctggtagtttttggcaagtctgaaggtggagctagtttccagggccagagagcaagatgtttttggaggggt

SEQ ID NO: 388514 - DNA, 232 bp, Homo sapiens
tgctgggattacaggcatgagctaccgtgttcggctgacagtcgttttttaaaggtcgttttcaattcgggatgcagattgaatagttaattgatagatgaaatgacagaactaggattttgtttaaaacataaaaagacctcaaagtggggagggtcctagtgtgttggaggcacggccaggaggccagtatggctggaacagagtgagcaggctgaagtggggatgggat

SEQ ID NO: 388515 - DNA, 441 bp, Homo sapiens
gccattggctgtcacacggccaaggttctcccatgccttcctagctcatctgacatcttcctctcctactcccagcatgcccctaagtcacctttttttttgtaatcagatctcaggttcctttatcttagttcatagtgattatttcgcagaacatgacaactcgcttaaaagaacagtgattgatttcatggagcacttataaaacataggtactgagtacttttacatatgttatttcatttaacctttatggtaacttgattaaaactttgtaacttttcaggtagctttgtttttgtggtacactgaaggaaagaggactagggaagttaaaaacctttcccatgatcacatggcagaaactgggagagtgagaactggaatccaagtctacctgattcaaaacttgttcttagtctgaactttaccataataata

SEQ ID NO: 388516 - DNA, 858 bp, Homo sapiens
ggggacagaagtcgctactggaaacaccttgggacaatgactgcacacacaagcccctccccccatggacatacgcaccctacacctcctctccccagacatacacacatccccgcttacaagctgaggtgggagggcagaagaaagaagcaaaaagccagcatcacccaggatctttcctttagtctgaaacttaggggttccctagccacaccccatggtccacaagggtccccaagtgcagccacagaaaggctcagaaggacctatcgggcgcatgtgtgcagggacacagaccccagcagcccacgccccctcctcttctgctcatcacctctggaacccccttccattcaattagtccggccccagccttctcctctgccctgccagttccagcacaccaactagagacactgcctgctgcgccctccacccacaccatgcacccaggggccacagaagaggaggtgcaggctggtgaagcctcctggttccaaaggggctctagggaggggtggcgcccgagcggcgcgggaggtggggatcacagacactgatgcaggcgggaggcggccgagcggcgcgggggctggctctgcagggaccccgtgtccccgggcgcgggcggctgcgaggcagcggacgacggggcccgcgccttggtggactccaggctgctgagtccggagtccttgttgtcactgtgcgcccgcgcgcccgcaggctccggggggccccctccgcccagctccttccactcgttgaagttgaggtcagtcagcgggctctgcaccaccacggtgtggcggcgccagctgctccggcgccgccgggtctcgggcgacagcggccgcc

SEQ ID NO: 388517 - DNA, 638 bp, Homo sapiens
ggggacagaagtcgctactggaaacaccttgggacaatgactgcacacacaagcccctccccccatggacatacgcaccctacacctcctctccccagacatacacacatccccgcttacaagctgaggtgggagggcagaagaaagaagcaaaaagccagcatcacccaggatctttcctttagtctgaaacttaggggttccctagccacaccccatggtccacaagggtccccaagtgcagccacagaaaggctcagaaggacctatcgggcgcatgtgtgcagggacacagaccccagcagcccacgccccctcctcttctgctcatcacctctggaacccccttccattcaattagtccggccccagccttctcctctgccctgccagttccagcacaccaactagagacactgcctgctgcgccctccacccacaccatgcacccaggggccacagaagaggaggtgcaggctggtgaagcctcctggttccaaaggggctctagggaggggtggcgcccgagcggcgcgggaggtggggatcacagacactgatgcagctgagagcgccggagcgcctcgtccgattaacccggcctctacctagcctagtttcttttttctttttttttt

SEQ ID NO: 388518 - DNA, 392 bp, Homo sapiens
atagagaagccaatgaaaaggtgcttaaagaagtatttgcaaaacatggtccccttttggaagttcttttgataaaaggtcgaaccagtaagtccagagattttgtggtcattatttttgagaatgctgcagatgctaagaatgctgccagagatatgaatggaaagtctttggatggaaaagaaataaaagtagaacaagcaaagaaaccatcttttccaagtggtggtaggcggagaccaccaccttcttcaagaaacagaagcccttcaggaagtctgagatctgcaagaggaagtagtggaggaacaagaccgtggctgccctcacatgaaggacacttggatgatggtggatacgctcttgatctcaacacgagttcttctagggga

SEQ ID NO: 388519 - DNA, 201 bp, Homo sapiens
cagttttactgtgtgtgcccttcagttctgactggctggagttctccacgatttaaggcactacccctttcctttatgtgtcttagcctttgggtaaagctgctgtagtcattattatctttctttggtggttatttcttcttctttttttttttttttctttttgtaggtcattcaatgaaacctatagttctcattggg

SEQ ID NO: 388520 - DNA, 383 bp, Homo sapiens
cctgagcctgggaggggacgcctggtgagatttcagagttagctctgcccttcactttctcctcttgcccattctctcgccctgcagaagatacacatcccatgtctgggggcctggactttctggcagccaattcagcctcattgggcctttgctcctggtttattcaactcctcattggtggccctcctgggccaggccaaccacgttactgcaagcagacccggccaaggcagcctcagggaggtggaggaacaattcctcccacatcaatatttattgcctgagagctgctggaagcagatcatcatgttctcagcccttgtttctttttaaagaacctctcacccccttccctccccactccccatccccagtgtgct

SEQ ID NO: 388521 - DNA, 229 bp, Homo sapiens
caagaaagggagaaattattatcagcaaaaaaatttggggggagttagaaaatccaggaaaatcaactaaagttccctcacaataggacaaaagtaccagaaattacctttactagcaaccgtaagaacaatgtcccagacctaaaaatatttaaatgaatggaagaaatgccatattgtggaatattaggattgactcttggaaacattctttttaaataaatttatg

SEQ ID NO: 388522 - DNA, 447 bp, Homo sapiens
catttccaaaatatgtatttttttctattgatttctaattcagttgtgttgaggtaagaaaacattgtatgttatggattctttggttattttcaaaaacctcctttgtggcatggttttctgattaaattttgtaaacattccatgtgtgtgaaaagatgtgaagtgcagttctatgtccattagttcgaacttgtgaatttgttttgtctagtcttttaacagctttattgagacataattaatgtaacttaaaattaactcatttaaagtacacaattcaataattttaagtatcttcacagaattatgcaaccatcaccacaatcgttaataattttctgcgttctttttctattttctgaagcagtgctaagaatagaacaatattatgagccacattttattgtaattttaaattttctggtagccaaatttaaaaggtta

SEQ ID NO: 388523 - DNA, 308 bp, Homo sapiens
ctagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcat

SEQ ID NO: 388524 - DNA, 423 bp, Homo sapiens
gcaggtgggcattttggaaaataagtccttggggtgattctcctagagatgggcctagcttgacaacaggtaacagagctgtgacgtcagctgagctctggcggttctcacactgcaggattccaactacaaacctagaccggggaggaacaggctcagaagtaggttttcgccgggtgcagtggctcatgcttgtaatcctagcactttgggaggccgaggtgggtggatcacaaggtcaggagttcgagaccagcctggccaagaaggtgaaaccctgtctctactaaaaatacaaaaattagctattcaggaggccaaggcaggggaattgcttgaacctggatggcagaggttgcagtgagctgagttcatgccactgcactccagcctgggcgacagaatgagactccgtctcaaaaa

SEQ ID NO: 388525 - DNA, 352 bp, Homo sapiens
tttttttttaatattaggtatagagagagtcaaccattttccgtcttgtacctaaagaaacttcactatcttttttgaacgtgcttcctttgaacttgactatttctgatcaattattagtgtcactgtggctccttaagataaatgccaacccccctactacctaacttgctatcatacacagatatcggcaccttagttaagctaaatcatgtatgggaagtggtaaataagtattctgcaattattttccaagtttatttgacaaaatttaggatctattttatgagaatttttcacagattctatttgaggcactgacaagcatgaatacatttaaagtagatttgaa

SEQ ID NO: 388526 - DNA, 384 bp, Homo sapiens
aacagtctcttcaacaaatggtgctgggaaacctggatatccacatgcaaaagagtgaggttgggccgcaccttatgttgtacacaaatattaactcaaaatagatcaaagacctaaccgtaagacctaaaactataaaacttctagaagaaaacactctctgacattggatttggcagtaatatcttaaatacaacaccaaaagcagaggtaacaaaagcaaaaatagacaaataggactatatccaactaaaaaacttctgcacatcgaaagacaataaatagtgaaaaggcaacctacagaatgagaagaaatatctgcaaatcatatatctgctaaggggttaagatctagaataggcaaggtgtatggctcacgcctat

SEQ ID NO: 388527 - DNA, 432 bp, Homo sapiens
ccatatttaatgcaatgcttggcagtactagcaagctacttctatgaacatgaacaagtagttgatttttggtttttaattgttgcattttttgggtttaaattataaatgaatgttactttagctttatcatttttgatttaatttgttgagatttatttggccatttattgagggtcattaggttaaacattatttggatatttggttgatgagtattagcattaatagtataagctcaaactgcaaattgtttatttttttcttctaagttgtcactgggttctttttcaattggaaaggtggaatgaatcagagagatggattagaaccataaaaaatgttccacatcactaatatcagagaaatgcaaattaaaaccacagtgagataccatctcacacgagtcaggatggctatggttaaaaagtc

SEQ ID NO: 388528 - DNA, 972 bp, Homo sapiens
aaaggactcatttatgactgacttgaagaaaaacagtttaaaaatgattagggataggtttgttaaaattagattgccagaccaacttagatttttctctgatgcagttagtagactagcaacgctataatatatttggacttaagcttagcttttggtaaagtcattttgatatccttgagagtaaagtgggggaacaataagttagctaccagctgattgtgataattaatttacacaattctgactttaaatgatcccatccagagattcattgatcttgaaaggtggctttgttctttgctttgggtaatatactaaatgttccaaaataatttttgaggctgagttgttgtactaagtttagatgaactttttgggagtatatatgtaaggcctaaaaaacaccaggatacattaaggtagcatcgctctacagcatcacatatgaaaaagacctgagggtggctgttggcagtaaactagatataagacaaaagtatcatatggcttcccatcttcttcctcacccctcccctaaaaaatccatttcaattaatggaagagtagagtaactgctgaataccaaagtattgttatttttagttctgtgaatattcaagaggaaggatgtgaaaaagttgggtatgttgccagtttaaggaactaagaatttaagagaaatcttgggctgggcgtgatgtctcacgcctgtaatcccagcacttggggaagctgaggcgtgcgggttgcttgaggccaggagtttgagaccagcctggacaacatggtgaaaccctgtctctactaaaattacaaaaattagctgggcatgttggtgcacgcctgtaatcccagctatgttgagaggctgaggcacgagaattgcttgaacccaggaggcagaggttgcagtgagcagagatcacgccactgcactccagtctggatgacagagtgagactctttctc

SEQ ID NO: 388529 - DNA, 1199 bp, Homo sapiens
tcatgaagaatggaagagatcagagcagaaagaagaaaaatattaagacataacagaagaaaactttctgaaacaaatacttaaatctgaagctcaaatggacacatggtattccaagaaaaatttgatatggaataatccatactaagacatttccaccagtgctcagcactagaacactacccagtacatagtacgcactcagtgaataattgttgattgggcgggcaaatggaagaaagtttcatatggctctcccggctgaatgaacaagtcacataaaaggagaagaagacaggctggcttctggttttcttaaagaatcactcagtgccagaaggcagtaatgtctatgaagtcctaagtgtaataaggggtaactgaagaattgtattgccagtccagttgtacagaagcaacagatagacactttcaatatgaatgaactgagggaatatactactcatgcactttccagaaaacctgtagacaacaaaatgatgagtcaaaattcaaaacctagaaatgaagaagctatggtaaaagcattcatggtgagtacagtaatgattttgttttcgtattggattaaaactaaacaactctgcttatggaacagaaaccttgacaatgtggtagtaatataaataaccaaaaccagtacttgggaggaagtgtgagtactgatttctttactttcataatggggaatagatttgtcagtagctaaagtctgaaattgaaatatatagttgaaaaaataatgatttcagcatcctaatgtttttcattacttttttcttaactttagagagatcttttagaaactattctctctttgtgaagacccattcatctgaagttctacaattccttcagtttcacctcaatttctgtttctttgttaagttcaagcaaagtttatacttaatgctttttcactacaataacatgtatggtatgattccatttatatgtatccatttacctgccctccctcctgcccttctgttctttcattcttctatcttttcctctgaacatctgcagaaatatgtctggaatgatgttgaccacatattatgatgtttatttctgggtggtgggatcctggataatttttttaaaatcttctttgtactttattatattgcctggcttttaaaaaataataaatatatcattttttcaaaaacaat

SEQ ID NO: 388530 - DNA, 7382 bp, Homo sapiens
ggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctgttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388531 - DNA, 7242 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaggtcttactctgttgtcccagctggagtacagtggtgcgatcatgaggcttactgttgccttgacctcctaggctcaagcgatcctatcacctcagtctcccaagtagctgggactattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388532 - DNA, 6536 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388533 - DNA, 6331 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388534 - DNA, 6437 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388535 - DNA, 3700 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388536 - DNA, 3577 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388537 - DNA, 7088 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388538 - DNA, 5077 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaaa

SEQ ID NO: 388539 - DNA, 413 bp, Homo sapiens
tgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttag

SEQ ID NO: 388540 - DNA, 346 bp, Homo sapiens
gcgtgagccaccgcgcccagccgagacttcaggtgtcttagaattttttaaatgtaccctttctgagaaaaacagagacttaaagctaggataactggtattctattttttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgcca

SEQ ID NO: 388541 - DNA, 7126 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388542 - DNA, 7003 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388543 - DNA, 6409 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388544 - DNA, 3817 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388545 - DNA, 3694 bp, Homo sapiens
aaaactgcgactgcgcggcgtgagctcgctgagacttcctggaccccgcaccaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388546 - DNA, 7193 bp, Homo sapiens
  misc_feature (123)..(123): n is a, c, g, or t
  misc_feature (128)..(128): n is a, c, g, or t
aaaactgcgactgcgcggcgtgagctcgctgagacttcctggaccccgcaccaggctgtggggtttctcagataactgggcccctgcgctcaggaggccttcaccctctgctctgggtaaagntagtngagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaacatgaatga

SEQ ID NO: 388547 - DNA, 398 bp, Homo sapiens
tgagacagagtttcactctctcacccaggctggagtgcagtgacataagcttggctcacggcaacctctgtctcctgggctcaagcgattctcctgcctcagcctcctgagtagctgggattacaaaattagcctgccaccaccatgccagactaagttttttttaacttagtagagacagggttttgccatattggccaggtgggtctccagctcctcgagtgatctgcccacctcagcctcccaaagtgctgggagtacaggcatgagccaccgcacctggttcatttttgatgacagagcaaacaagcaaacaattgaaatgcaggctgagtattccttatccaaaattcttgggacaagatgcatattggatttttaaaaaatttttcaacatt

SEQ ID NO: 388548 - DNA, 374 bp, Homo sapiens
atcattcccaaagaataaatatttcctgtgtattttactatactactacttccttgacaacaaataaacataacaatgcattttcatgccttcaagtcaagtagacttttcaaatgtgaggcaatattacatagttgacatttattcatatcattccacatatgtacatcttaattcaaaaatccatgacaaaaactaatttatatgcttccttttacctcaatattaactaaggtaaaatgagaattatactcttgtgatgttacatgaaaaatattagacccaagtgccccagagaaattggtagaagaaatgcccacaggctacaattttcttatacttacatggactgagtctctagtgcctggtgtcaa

SEQ ID NO: 388549 - DNA, 1437 bp, Homo sapiens
agctcactgcaacctccgcctcccgggttcaagcgattctcctgcctcagcctcccgagtagctgggattacaggcgtccgccactactcccagctaattttttatatttttagtagagacggggtttcaccatgttggccaggctggtttcaaactcctgacctcgtgattcgcccgcctcggcctcccaaagtgctgggagtacaggcgtgaaccaccgcacccagccacagtatggccagttttttaagtgtttcacatgtgcttcctaattatgtttcctttttttttttggaaactggtctcactgtgtcccctaggcatgtacgatggcatgatcttggctcactgcagcctcaacatcctgggcttaagcagtcctcccacctcagcctcctgagtagctgggtatgttgcccaagctggtctggaactcctgggcttaaatgatcctccggccttggcctcccgaagtgttgggattacaggcgtaagccaaggcacctggcctctgattgttttctacatatgtggcactgcttgttaattgtgttgttcaaatctttcatatctttactaacttttgtctgacctattaataattgataaaggtattttgaattctcctactgtaatggtagatttgacaatttcccctcttttatcagttttaactttatacattctattgagtgaataaagtgtggaattcttgtgttgtcctggtgagttgaactcttcttgttatgtagtgacttccttattgctaatgctttttgccttagcaaataaaaatctgttttctgtgatctcaatatagctttggttggtatttagtgtatatctttaaatccttttacctcctacgtgttgatggtttagttttgtctcttgtaagtcaaataaacctggattttggcttttcatttggccatctctaccctttagtagacaactttattccatttacatttattataattcttaaaacatgaagacttctatcatgttattttgtactatttgtttctcttttatgcgttttttccattacttattgattggctgtttggttttattattgttattattccatttctccctctgtactaggtttaaagttttacattctatttatatttttcttgtgtttactcctgaactttttcaatgcatactcaatacaatctaaagttatctggtatcataacccgttctttacttataatggactttggaacatcataagtctgatcaaccccttccctacttacatgctattgtaggccaatattctaacctctgattttattattattattactattattattattattattattattattattattttgagatggagtctcgctctgtcaccgagattgtgccactgcacttcaacctaggcgacagagtgagacaccgtctca

SEQ ID NO: 388550 - DNA, 231 bp, Homo sapiens
cccacttcagcctcctgagcagctgggactacaggtgtgccccacaatgcctggctattttttgtatttttagtagagatggggtattgccatgttgcccggctagtcttgaaatcctggccttaagtgatctgtccgcctttgcctcctaaactgctgggcttacaggtgtgagccaccacacctgaccaagtagtaagtgttactcattctttgtaactatttttcttg

SEQ ID NO: 388551 - DNA, 1103 bp, Homo sapiens
agatatgaagtcattagggccaggcatggtggctcacacctgtaatcccagcactttgggaggccgaggtgggaggatcatgaggtcaagagtttgagaccagcctggccaacacggtgaaaccctgtctctactaagaatacaaaaattagccaggtgtggtgacgcgtgcctgtaatcccagctactggggaggctgaggcaggagaattgcttgaacccgggaggtggaggttgtagtgagccaagatagtgccactgcactccatcctgggcaacacagcaagtctccgtctcagaaaaaaacaaaacaaaacaaagatatgaagtcattggagggtaaggaaggatgaaagtttgtgctaaggcaaaagaccaaaataaaattttaatatataatagttcattttctcattcatacattctattcaataacaattgagtgcctaccatgactaggcaatggtgctgtcatggtaggcactagagaattaccttctatggaaggaggcagataaataagcagataatgaaacaaatatataacttcaaattgtgataaatacattgaagaaagcaaagagcaggaattggtagactttttctgtatagggccagatagtaaataagctttgcaggctgtaaagtttctgccattgttgcataaaaacagtcacacacaacacataagaatgaacatggctgtgttccaacaaaactgtatttgcacaaacaggtgggggctggatttggtccacagtccatagttttctgactcctcatataaagtattaggaggaaagggaggcactttaaacaaggggaagacaacagtcaggagatcagtctttcctacggtaattttgagatgtctatgacacatccacatgcagatatcaaataggtaaccaggtatttgagagtggcactcagatgagaattctacaataaaaacataaattggaagccactggtataaagatgggaaaggatgagatgacaccagaagagaatagagaggtgaaaagggtctaggactgagcaccaatgaacaaaagttcatagtgtatgactcttagttcataaatctaaggtagtcatca

SEQ ID NO: 388552 - DNA, 310 bp, Homo sapiens
gtgaagagacaatctacagaacaggagagaatatttgaaaaccatatatttgttaaggggttaatatcaaaaatacataaggagctcaactcaatagcaagaaaacaataaccttatttttaaaatggcaaaggacctcaatagacatttctcaaaagaagacatacaactggccaacagatatgtcaaaaaatgttctacatcactaatcatcggggaaatgcaagttaaaaccacagtgcagtatcactcaaacctgttagaatggctattattgaaaagatgatagataacaagtgtcgatgaggat

SEQ ID NO: 388553 - DNA, 166 bp, Homo sapiens
tagatcttgcttttatggcatggctgtaagtggtttccactgggatgcctttctagttcacctctgtgtcctcatcaattcggcgctgaattatatacctgtgattttttttcacttcctttcaatgtcattactttctaattgcaaagcagaaacattcctagta

SEQ ID NO: 388554 - DNA, 405 bp, Homo sapiens
tcttttaatttccctaagtgcatgtagcaaagagagtgcaatatttgctttttttctatatgctttaactcttgatatactttatttatgctataatagaaatgtgtgtcttcccaaaatttatatgttgaaatcttaaacctcaaggtgatggtattaaaaggttggggctttttggaaagtgattaacccataatggtgccatccttcatgaatgggattagtgttctcataaaagaaacagaaggaagtgtgttttcctcttctgccatgtgaggataccacgaaaagatactatctgggaagcaaataattctctccagacactgaatccgctggcaccttgatcttggacttcccgacctccagaattatgagaaataaatttctgttgtttataaatca

SEQ ID NO: 388555 - DNA, 521 bp, Homo sapiens
ggtacacctaacccagagtggcaaggcagtcagagatggcttcctggatgaagtgaacttaagctgagtttaaaggataagcaaacatctgttgaactttttgaaagagaatctcttaattccacagaaatactagtgtctttagcttcatattcagagggccagaaatttctattttttaatccctgtagtacatgtagagacttatcaaactaacttggtgctgagcttgaggtttttagagaagtattttctaatgtccagggtgatggtatgtgactttgagataggtcaccagtggggctgccacccagacactgttagtgttcttttcagtggcttagctgctgactcgtccctcagttatacctgaaccctacgtctataccctccccagctcacttgcccaggcaggggcagagatgactgcaaagctggaggggatgtcagctgggtgacaggtggcctgggctaggcctgtgggacagcttggcctctctggtgttcagggagtggcctct

SEQ ID NO: 388556 - DNA, 387 bp, Homo sapiens
tccccaaaaagaatttccatatgtaactttcacagcatagatttcttatcacgtgctacaaatacaaacaataaaaacatatgatggtattaatattaaaaacttataaagcaaattttattaatgaaattcagcaatacccctttgtttcaagtatctttggtgattgaataatatttgggtcaaaatctgttacatatatatgatcagttttagtatgtctgcagcaactgcatttttgcactaaaatcctttttacctaaatgtgtagttggaaatgctaccatagaaagaacaagtcagatgagtagatttttcagtgatttctaaataatttctttattccattaagctcccctctctaaaatcacctcccaaatcactggc

SEQ ID NO: 388557 - DNA, 495 bp, Homo sapiens
gtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaatta

SEQ ID NO: 388558 - DNA, 3561 bp, Homo sapiens
  misc_feature (907)..(907): n is a, c, g, or t
  misc_feature (1325)..(1325): n is a, c, g, or t
  misc_feature (1627)..(1627): n is a, c, g, or t
  misc_feature (2117)..(2117): n is a, c, g, or t
  misc_feature (2850)..(2850): n is a, c, g, or t
tactaaaaatacaaaagttagccaggcatggtggtgcattcctgtagtcccagcttactcgggaggcagaggcacaagaattgcttgaacctgccaggaggcagaggttgtagtgagccgagatcgcaccactatactcccgcctgggtgacaaggcgagactctgtttcaaaaatagaattttttctaaggtaaaaggaggatgtaccttaatcaggtttgtcatcaaacatccaagcctttagcattggctttgccctttgcttttacacagctctgatcttgtgtcctccttctgttatgtgtaaatttgccttgtctccattcttgctttccagctattttagaattgattctcatatcctggcctgtcttttaaatgtctctcttctattttgaaacaatatacttctttcattcaatcgaaaacctttgctgaatgcctctatgtgttatgcccagggctacatgctaagaatagacagataagatgcagttccgtagtttctgttcccttgaaagagcagagaaataagtcacagcactgtgtagtaagcataacactgtattgtagaaaagtgtagactgaagtgtggacaaatgccagagaagcctagaatcctaagcagctactttatcctgggaaggatgggaaagacatcagcaaaaaaggtgaaacctcagccctcttctttgtcataatgctctgttttctctttccctagaagagctgcctccagaggtagggtatgttaaatgatatattgaagtacaggagtaactagactttctatttatatattttttaaaacatgaaaaaaaaacctaagctttactaatatataattctcaggtttatgttatacatacacacatatacgctatgtttttattaaactatatatgngtatatagggagaaagcgaggatatgtgcttaaatattttttactgatgcagtgtaagatcaaagtttggacaccactgctgtgatcatttgttcttttagctagccatcagttaggcacaaaataatttccaaatttcatcccaaactgtaccaaagtgctacttataagcattttcacaacttcattcaagtgtgctttcaagaacaaagctgtgagtcttcattcccactgcccccatttcctccccaaaccagttaatcagttcttggggagtctacctcttaaatatttatccactccccattatccccacagacactagggcagccctcatcatctcaccaggactattgttagcctactaactgctcttcatgttactggtcttaactccttccaacccacctggcttcanagtacacctagagtaatccttccagaatgcaaacaaaatccttctaattccctaattatctcctagataaaagttaagctatttgacaaaaggcacacttcatgacccagtccaagtgctaatacccacaaactcttcacagatgggccatcagtttgtgaccactatggaaggttgatttgggctgccattgagcatgcatactcttatggacgtgtttgtcagactgaacactgagctgagtggatcatgcaacttgtgtagaggacagtataaatggctgaaaataaaagccaaatganaggcagatgtgaaaataaaaaagcctgtgcttactagaacacacagtcactttgtcttatgaatgtatcatcaggcatagcccaggtgctgagaaataaccaagtaactaatgcacttaataactggatccttttaaaaaccaaacaggcattgatgtcagatttcattattgctgatctgttcaatattgatttggatccttttatctttccaaggatgtggccaaagatttctgtggtgtatgcctctaccacaaaagcatttagaagtacaaacccagcccttgcctatgtctatcctcatatcctgccactcttcctctaccccacacaccaaacccctatggtctagccatactaaagagcaaattatctctaagtatgcctttcaagcaagcttcatcatcatgaatcaatgcctttatacacactgctgctttgcttagactgctcttctactttattctactcattacacttctcatttttngggacttattctaagcattatctcatctgtgatgctttttctagtcctcccagctcaagacagagtttggaatacctcctttttgctctcatagcatgttatgcattcctactaatatagcacctcctagtatgtagcgcttagcaaattatactgtagtagccaacagttcaaagctctggatccctgaggtcaggaacgccttaagcactggactgctggaggtctttctcatctttgtacctgcagtacctaatgcaggacttggcttacagcagagaatccgtacacatgtggggagtgaacgaactcaggatcttttttctcctcaaagcattgtaatcagtactttagggaaaaaggtagaagcataagaatattagggcaagatgcaacaacagcatcaacaatcacaaccacggctaattaatacttaacgttcgtcaggctctattctaagctcatacatatattcactcatttgtttctcacagcaaccctcctgtcctcattttacagatgagaaaaactgaggcacagagagactaattaagcaatttgcacaagatcacacacacaggctgctcgcggtgactcacgcttgtaatcccagcactttgggaggccaaggtgggtggatcacctgaggtcaggagtttgagaccagcctggccaacatggtgaaaccccgtctctactaaaaaatacaaaaattagctgggtgtggtggcanatgcctgtaatcccagctactcaggaggctgagacaggagaatcgcttgaacccaggaagaggaggttgcagtgagccaagatcgtgccattgcactctagcctgggagacagagtgagactccatctcaaaaaatataaaatataaaatataaaaaaaaaaataagatcacacacagagaaggcagcagaactggttccagagcctttatgctagaatagaaagtgcctgttattttgttcattctcctcctcgtccagtgtacagctgtagtgatggggaaacaggaaatcaattactaggttgccactaagtctacaaactattgaagaccagaatttacataaatcgtatgcagtcccacatctgacaggcttgcaaaaccttccacatttccatgagtaagcctatccaaatagtactacttctcaattgcaaatcataacaacctcttgtgtggccgtcagagctgactaagcagaaactatgatcctctgaatttagtatttttcctgtttgccaaaaatgatgtgtcattagtgacgaagttattcttaaagttcctttaacaaaactgtgatttatatcaaataacaatggcttggagggggtatggaaaattgattattcttcctaacaaatctattaattttattaaacttggtctccctccctttttcttggatgtttataaaatttaagtctttctaa

SEQ ID NO: 388559 - DNA, 261 bp, Homo sapiens
tatactgaataacaaataggtgcccagtaaccagttgctgtcaaattttgggaaaagttatgtgattgcttactgatcatgatgcacatctcttatttacttagtgatttgtggaccaagcattcagaagctatgcacttactcaaagttgatatactgtggtaactaagtgttgaaccaggttgttggggactgttatttatactgtgatggctggtacctgtgtatttcagaactgtgcaaaagcaaagactgcttgtg

SEQ ID NO: 388560 - DNA, 293 bp, Homo sapiens
aaaatgcttgttgatattttagttattaattcatattaactttggctgaaacttttaaattctattgtgaatagtcaagtaaaatttagattgttacattctgggttagtattagattgtttttaagattgttttaaacaagatgtttttaagatgagttttaaatagttctcttaacacaaataaagcttaatatgagtatttgaaggaaattatcccaaaccattccagttcctggctgtgaaaggcttttccaggcctaataagttttccacttcagccgtaagtaggtg

SEQ ID NO: 388561 - DNA, 409 bp, Homo sapiens
gcatttaatgactatgtaaaatatggactaaaatattgtacattcatggaggtttaaccactggatatttatgcctgtattaccctgatacaaatattcagctgtatctgaatagttaaaatgtcttttagaataccacgtgggttagacagaagttcactatcaataatttagaatatatgtaatcttacatgctgccaagaaggaagtaaaaataagtacataatctttgagaggtcaggattcattttttctgtcgtgtattcattcattaaaatgatcgaatattcaatgttactctcagtattgaaattgggagcaaatgtagtccttgctttcatggagcttatagtctctggaggtgatagactttaactaattaataacactcagataatacaaatatggc

SEQ ID NO: 388562 - DNA, 688 bp, Homo sapiens
gacgagagcaccctaaccatcagggtaatatcctctaagtgctggtgtcctgtaaatgtcagaagcctggtgggattaatccacaacctcaggttctaattcaggtcagaggcagacaagtggtgattggcagttttacttaattgtcaattaaaggctctctgatgacaggagggatcgacattccaaggcaagcaatgcagttgacaattaagagctaaaaattaaaccagccatccatatcatcacatgcccaaggcttcataggaacccttggtactgcaattgttcccaggtagaaaatgaggtccttgaacctggccatgatggggcaacagctggaaatcttgctctagccctggatcccacaagatcccctgctccctgacaatctctcagaggctccccatggcctctcagataaggccctggccttgatatggcctctggccacctctccagctgcattgctcccctccctgaacttcatcctgtatcctgacctcaaaaactttgcagttggctttatacatcctgctctgttcctgctgcctggaacattcttccctcctttgcccttcaataaaccacctactctgtgaagcctcttatgccctctttttctgcccacagcactctgtacatactagaattgtatcaccttgctgctgtggactataatgtgttt

SEQ ID NO: 388563 - DNA, 454 bp, Homo sapiens
atctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaattttcacc

SEQ ID NO: 388564 - DNA, 795 bp, Homo sapiens
cccaactgaggcaaaatggcctcagagtttaactggtatatgaccttcctttaggaacactggactggtaagggaaaacgcctcaggtgagcatgcacacaacttcagtaaacacactgcacacgcaggccctcccaagcactagcaggccactgcacatgcagacagccaaagggaagaatcaggagagaagggctgcaacctcccaagaagcatgccaatgtgtaaaaccccaggtcaaaggtcaaactgtgcccttgatctctcaagtctcccacttggccctcttccaagtatattttgtatttttttctctcttgttctaaagctttttaataacttctactcctgccctaaaacttgcctcagtctctcactctgctttatgcactttggtcaaattatttcttctgaggaggcaagaactgaggttggtctagacccatacagatttgccaccgatagcaatcatggccaagtcatttcctctcaggaacttggtttcttcatccatacgatcggaggtaagagtaggcattttccatcttttttttttttttttttttttgactctagaaatactactttatctgatttttaaagaagatttccatctggctctggtgactttgaaactctgtgatcatatacgcgtgagaaataatgtggggcgccatgatttactctccactccacacatttacagatcacaaaaatgagatcccttgtaaccaggttcagaattatttaattgaggttaagatctaattttcatagctcaaaaagtcatgtatg

SEQ ID NO: 388565 - DNA, 109 bp, Homo sapiens
gtgggacaggagccagaggcgggtggagcgaggcagaggcccaccactgtctcccatgccgctggctcctgcagctgcctctttactgactgtgccgacccttccccag

SEQ ID NO: 388566 - DNA, 591 bp, Homo sapiens
cgtgtgcaagtcctgtggaggagaggagatgagagagcaatcgagtcaaggtctcactaggatgtccaggctggcctcgaactcctgggctcaagcaatccacctgccttggcctctgaaagtgcaggaattacagctgctgtgccctgaggggtgagggaaatgtggtcgcctaaaacaccatcaaaggttgctgcttaaacacttccctcagccatatatgaaggctaaatcagataaagatcccaggaagtgtgcaacaggagaaccagtgacacaatccaccttggtatgagtgtcagccatcttgtctttcaactggaaagctagaagtgacagcatggtatattaagaggtctctgcttgaataaattgatgtcaagttttattacatatagaccaagctagaaggcacaagacaaccactcaacaactatgtattaaacaacgaaatcaacgaaatggcatacagcagtatttcaaattcttgaaatacagatagggacaggcaaaaactgtattctctagaaggctgaagtcagccaaagaaaatgcacagtaaacacaaatcgagatatttataagatcctt

SEQ ID NO: 388567 - DNA, 529 bp, Homo sapiens
acacagtgatggcctgcagtggtgaaccagtgagggaacaagtcctatggttggggagctacctgaggctggagagcagagtacagccaggcccacagtggtgcagcataccagagtcaaggtctcactaggatgtccaggctggcctcgaactcctgggctcaagcaatccacctgccttggcctctgaaagtgcaggaattacagaggagtgtatttagagtcaacaaccacacatggctaatctctcagaatgtttcatcatgagatgtgagcatcatgttccaggccctgagtgcttcataaaaaaaaaagttccttttccaccaaaacaatgccctgatttgagtgcttcatcaaaagagaaagatttctcatgataaaccatattctaagcacttagatcacaatatagtaaattttcaaaaggaagtcacttttgccaagatataaaggctcatgtacgtaaattctatgcttccaatataagtacatttcaaaaatattattaaacccttatttactgagt

SEQ ID NO: 388568 - DNA, 298 bp, Homo sapiens
gttggtggcatctggggacattaaacagtgacgtggacacagtgatggcctgcagtggtgaaccagtgagggaacaagtcctatggttggggagctacctgaggctggagagcagagtacagccaggcccacagtggtgcagcataccaggtctccatccagttggctaggacagtgtcctgtgccccttcttccctgaatccccttctcaccctagatgacccaagagtgtctctgaataatacattgcttcccattttctattcattatgcttcagtaaacttttttattttctta

SEQ ID NO: 388569 - DNA, 456 bp, Homo sapiens
aggatgtcataacttgacctcataatggcatcttggcaatgaaggaacttaatgagcaagcagactgtgtgttgcccattgacagtctttatttgacatcattagcaaagtcgacctcatagtgaattctggaaagttgggtacaactgtagacgacttcaagtgctgtggctttaaaaagcagaataagccctttgttgcagtcaacaacattgtggcaaatttgctcaacctaacaagctccgcaagatttgaagggtcccttaataaggaccataatgaaatcagcatgaatttagttccttttcctcagcttcattatcttgtatcaagcctaacacctctatacacactggcggatgttaacattcctactaaaagattggatcagatgttttcaaatgcctttagtaaagatcaccagctgcttcaggcagaccctaaacatagtcttta

SEQ ID NO: 388570 - DNA, 400 bp, Homo sapiens
gagaccgcaccacagcaccccagcctggtgacagagcaagactctatcacaaaaaaaaaataaaagaaaaagacaaaaaaaaggcagcattttagcaaggtgaatgtggcagcctttcccagatcagcacagccaaaatagcctggatggaagagtcacagtcaaacagttcctgaacgcccactgtgagccaggcatcatgctccccacggaaggttacccagaggacaggatgcctgaactgggtcttagagaccagcaggagagcactcctggatttcttacagcagtgacgcccaagcctgcctctgtaactccatccaaatacagacttccaggccccacccaggagattctgagcccacaggctggggtggggcccaggattctgtattttcaa

SEQ ID NO: 388571 - DNA, 637 bp, Homo sapiens
cataaccagaccccatttttacaaaaaataaggacaaaattaagtgggtatggtggcaaatgcctgtagtcctagctacttgggagactaaggtgggaggatcgcttgagcccaggatgtccaggctgcattgagccatgattgcaccactgactgggcaacagtgggagaccctgtctcaaaaataaaaataaaaacagtttatagccccactaattactgatagatgtggtgttattccggaaatgcattcttatcagtacaggcatttcaagagaggaataaaatgctgacaacattatttttccacttacattgaccaaacccaggcgagcacattagtataaggcttaaaaggggattttaagtatatttaaatgttttgttgtggtttgatgttaaaatatgtttgccttatattttaaatgattagagttcttgtcaaagtctccatctatcttcttcctcagggacattgatggatttgctaatgatttttaaactacatcgtgcaatataaatgctaattaaccttccttagatatgatactgtatatttaatacatagcaatccttatttttaaagtgatttaacttccttttttccctccagctttatggagatatgattgacaaa

SEQ ID NO: 388572 - DNA, 460 bp, Homo sapiens
ttagtagaaacatggtttcaccgtgttagccaggatggtctcgatctcctgaccttgtgatccgcctgcctcggcctcccaaagtgctgagattacaggcctgagccaccgcgtctggcccacatgtttattttcaactttacttccaaactttatgatcacaatggaaggctaccaggaaaaagcattcttttagtgggttttctcatgaagatttaggaagaagataacttggcaattagagtaaaagtattaaaacacttaatccaagatctagactagcatcattgtgttgtattgggcttaagatgcttattttctttcaggtgctttgcaaggcacttatgttcaaggctatctgggtattaatcctgattcagctgtccaaagaagataagcatgaaattatccttccaacatctattaagcaagcaagacttaatcatgccaaaaccaacct

SEQ ID NO: 388573 - DNA, 699 bp, Homo sapiens
attctaattagagccttggcagagctccagtatagtctaggccagtacttctcaaccttgactgggtgtgtgaatcacctgggggtgtagctgattctttaggagtgggctggtgcctgggattctactcctgatctgtggacaacagtttgagatgctaggcattaaactgaacttccaggattggctcccaaaattacagcacagaatcgggccgcctaaggagctgcggcctcccctgcaaccaggaagctgcggtatctgacatctgccaccaacagctgttagcaacagagctagcactcctgcagtgacacccactggccaagtaaatgtccacacactccacctctctgctcagtgacttagatccaaatccaaatcttacctgactacagctgcttggtggatcctaaggccacaccctgaatctacctgcaaaagatgcctgggaaacatatttgccagctcttcagtctcagcacgctagagagggattgaaacaagtgttgaataaaccaattagcagttatgagaacagtgccaggaaagtcacactgcctaccttactgaagcctgaaagtctaccatttgaaaataatttcttaaaattaagcactgttggccgggtatggtggctcccgccagtaatcccagaactttgggaggccgaggctggtggatcacgaggtcaagaga

SEQ ID NO: 388574 - DNA, 297 bp, Homo sapiens
taaaaggtgttaaggctgtttggtctgtggagggcaagactaaagggactaccatcaagtttctgaaattcatgaagagtatgatcaatgatacattttcatatcatattcaattattgagcacctactgtgttcaagttgctcaacattaaaagacagtcctcggccgggcgcggtggctcatgcctataatcccagcactttgggaggccgaggcaggtgaatcacgaggtcaggagttcaagaccagcctgactaacatggtgaaacccccacctctactaaaaatacaaaaat

SEQ ID NO: 388575 - DNA, 338 bp, Homo sapiens
gcattcctatgacccaggaaattccaagggatctagtagctctgtgtcaggaactgggatcggagaccaaatattagatggtctaatatttggagctaaagatgctcctatagcatattttcccattatttcacagcatcatggcattgcatataacctcattttttcatatatgacctatctctgatctattacctcacctccaaggtcctgggagataaggaggcaatgacatcatttttcagggttgttttagggatgaggggcaaggcctctcaccttgagagagagtggcagtgttgggcccactaatagaggatcccacgaactgccagagg

SEQ ID NO: 388576 - DNA, 374 bp, Homo sapiens
tgatttatcactagttctaactagccttccatcagtcattccaaagtaatggtctgtaatgagaaatcactatgtataattatacacaataaaaatatatacaacaggtattttgataatatgataattaaaaccaaatatagtcattgaggcttagaatttttaaaaactgtattatatattgtaaaatcccatccttttttttttttagatggagtcttgctctgtcgcccaggctggagtccagtggcatgatctcagctcactgcaacctccacttcctgggttcaagcaattcccttgtctcagccctccgagtagctgggactacaggcacccaccactatgcctgaccaacttttgtatttttagtg

SEQ ID NO: 388577 - DNA, 857 bp, Homo sapiens
tcctggttcatttaatccaaatgctgatctgtcttcagggaccaaacttgacactttccatgaggacttctgtcaccattcctgtccctttctgacctttaggttcctctggggtttactggacatttgtgtgggcacctcatgatgtactgatgtattaaatcagggagtcttcttacacttttgtaaactctacattgcctagcacagttctatggacttaaatattttattctttgagttaaaggaataggtgcagtgaatgaatcaaagaattctactcaatatagccttgctctactaaccttaatcagttactcctagtcagggtcatttaaatagtctccagattgcttttcagtgagacaacccccctaccccccgcctttttttaaaccaagtttttagttccctgtagaaaaccatgggggaaatatttcttgtcgtaatatagatgagaaactgttttggttctttactaccatcttgtaatgcattaatgcattgtagtcctccttggagttttaggaggatcaatcctacttacatttcacatgatttgaagtatgttaaaaagatcccttatgtacagtgtattaatatcatagataaattctgttgacaggttaatgattcttaaattcagctgcccatcaattgagtagttttaaaaaatgtagacttcagtccaactctagccctactaaaccagaattaaggtaggagtggaggtgagaatggacttacttagataagctcattcttagtcgtagatagcttgggaatctcatatgcagagtatccatattgactgtagaagaaaaaagctaaaatgtctgtatgatagggacaagtga

SEQ ID NO: 388578 - DNA, 423 bp, Homo sapiens
ctcccataattcccatgtgttgtgggagggacccagtggaagacgactgaattatggggatgggtctttcccatgctgttctcgtgatagtgaataggtatcatgagatctgatggttttaaaaatgggagcttccttgtacaagctctctttgcctgctgccatccacataagatatgacttgctcctccttgcctttcaccatgattgtgaggtctccccagccacgtggaactgttaagtccaataaacctctttcttttgtaaattgcccagtctcggatatgtctttatcagcagcatggaaatggactaatacaaacacttactattagaagttcttctgtacgttgctctaaaatctttttcactcttattttgtaacactgataattctgccaccacaataaacagaacaagatt

SEQ ID NO: 388579 - DNA, 206 bp, Homo sapiens
cctctgagagatcagcagggtgaagaaaagggagtttttatggtgctataagccagagaccccaaaaattgccatcaaatactcatccattctgagtgcaaaactcagcaagccactgtgaaaacaactcccaaaactagaagattcacaggcttccatttacaagtgagcccagaaacactaaggggagaccttccacttctgca

SEQ ID NO: 388580 - DNA, 780 bp, Homo sapiens
agcgggcgcgggggcgcccctgcccaccgctcccggcagggcttttggtggccatgggggataaggggcgttgactcacccgggcggggctccgggagttgcacagaccaaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgcccccttgccagacatgtggtggg

SEQ ID NO: 388581 - DNA, 744 bp, Homo sapiens
agagtctgtgtcacctgtgtcagctgtggataaggaatgagaccaccatgatgcaaggagaggtggctcatggggcctggctcccaggacttttcctgatgcatgtttgcatttctggggccggaatcaagagcctctgggcttgtggcttcacagaatggtggaagaagactggtggagttagagacagaagactcaaccatgataatcagcttgttaatcagcattttggttcaaaaataatttgggagtgtattgatcaggtttctgccaggctaatgttgcacaacaaatggcctccaaattcagaggcttaaattatttctttcttgctcactactcggtgttaagctgtgtctctcatgggctcatttgggaataggaaggcctggtcaggttctgggctaggtttaaggtttaaggtttatgtcctcattctgggatcaggggatcctggggcatatttttgtttgtgcttctcctgtcaggtataggaagccaagataaatcatgcaggcaaatttaaagcttctgtcggctggttgcagtggctcagcatgtaatcccagcactttgggaggcacaggtgggcagatcacctgaggtcaggagttcaagaccagcctgacaaacatggagaaaccccgtctctactaaaactgcaaaaagtagccgggtgtggtggcagacacctgtagtcccagctattctggagactgaggcaggagaatagcttgaatccag

SEQ ID NO: 388582 - DNA, 411 bp, Homo sapiens
gggggcggggtgcggctggggcgaattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggc

SEQ ID NO: 388583 - DNA, 477 bp, Homo sapiens
gggggcggggtgcggctggggcgaattagttgccattcggagtgaggagtgggtagaagcggcggcggcggcggcggcgtttgcggtggcgcggactccgaggagcgccagcacctcgagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtccccctttcgcaattccaccaaacacccacaccccaaccacacacaacacttcacaaaatccacaccccaccaccaaccaaaccccacacctaccaccacccaa

SEQ ID NO: 388584 - DNA, 973 bp, Homo sapiens
  misc_feature (11)..(11): n is a, c, g, or t
  misc_feature (23)..(23): n is a, c, g, or t
  misc_feature (52)..(53): n is a, c, g, or t
  misc_feature (64)..(64): n is a, c, g, or t
  misc_feature (330)..(330): n is a, c, g, or t
agttttccccngagtcattgtanagtcacccgatctaaatagattacttaannaaaaagataanctttgtcatatccacagtcagattttcttccaaatcttccttgctctcagaatcggtagttttgaagactcaatcactatggggcttttcaggaacacccatagctaactgtcgtcctatgttccccaccgtgacgcctcctgagaaaaatatacaagggagccaagaacgaatatagaggaaatctggggatgtatactgatagacaccattatacacgagaaactgcgtgatcagcgtagctagaaaagctatggtgatccccnacccaaggccacttctggaacgatcaaatgtccaccaaaggcccaaagatagggaagctgtgtgtctccgcagtgacgtgggcgggccgaggactcggtgacgtcagagggctgtgtgtagcgatgtgtgtggggttcggagccgccgggcacagccgaagggagcgggcgagcggcgacggcggcggcggcgggcacaggtgcggctccggcttacggcggcgacgcggcggaggcggcgggaggccagaggcgctcaccctcctaggagcccgacggcggcgacaggggcggtggggaattcacaaagctcgtcgagcttacccgggcaccgaggcccgagtagggggtttggatgcgcgggtcccgggtggggtcggggccagagggggtcgctaggcgggtgttccacggctgatcacgcttcgttggccccaggcggtgggcgccggcagggcagggcgctgtagttgacgggagccgcggggaccccggagacccggacgcccgtcaccgcccccctcccccagtccagcagcgctccgcggggatgccctggtctcgacccggtccgtcagcccccggcggcgcagggatccgcgcccggcgcctaaactgccctggtgtcctcttcgttctggcc

SEQ ID NO: 388585 - DNA, 560 bp, Homo sapiens
ctacttgggaggctgaggtgggaggactgtttgagtccggggtttcaggctgcagtgaaccatgatcatgccaccgcactgcagcctgggtgacagaacaaaaccctgtctctagaaaaaaaaaaaaagaaatccaagtttttatcaccttctgagagtaatcaacattcaggaggaacagagaagaacaaaagaccactgaatggttgagggtgggttgctggttaggttcagtggccagctgagtagtatctgaaaaattcattagtaaaattatggcactaggggtgagtcatgcagtcgaaggatgaatactaaatccagtacaaacacccatggtctttctttacatgaattccagtgaaaaatttctaagtgcctaaaatagcaagcggtctgaaatgatggcagcagtttattaaagactgaaaaaagaggccaggcacggtggctcacacctgtaatcccagcactttaggagtccaagaccagtggatcacaaggtcaggagttcaagaccagcctgtccaacatgctgaaaccccgtatctacagaaaat

SEQ ID NO: 388586 - DNA, 851 bp, Homo sapiens
ccgctctggggggtttatcatcagaaggagagagacccgagggagccacctgcccactccagatgaggtgctccgtggaacacgaggagcacacgaaacccgatcagctttgtgtgacttccgcgtgtggggtggcacgcgtgtgcttgctattcattgtttctgctgggggcatttttatcttttgaaattctttcttctgaacctttcgtgcctaccagaaccagcctgtcaggatgcgcctgatctccacagcagcccctccatccgactctgaagaagccgtcagctcacagaagattccttttgtttaatgagtaacagctactgactcactccatggcccaccagaatgacagactcctgttcaaaagcctgatctgaagttgctgccatgacacaagcaatgcctgtgaagtgcctgcagcccacgcctctgagacaggccaggcgtgtggtggacacgcagctgcaggcgcttgctctctgtcatcacgagaaaaagtatccctgcaccggacaagaaaggacctgcaggcacactcacaatcaacttcctgatttcacaatgatggtagggagccctgtgggcactagaagcagcggggaggggttctagacctttggtgcccaagagacttccgtgcatggaaaatgttgacttctagcttccatctgcagcgaactctccatcgggacatgggacctggctgtacgagttaattcaaactgagccactttccattagggcaccaaatggagttagcaatccaagattattttattttctgggctatccagatgacttaaagcctcgctgaagttcccatgagaagagtttaaacaaccca

SEQ ID NO: 388587 - DNA, 427 bp, Homo sapiens
tccatggaggctgaagtaactgggacacaaaagacagagcctccagtcccaggctctgctgatctgggctccttagggaccactgggaaagctggaccttgtgcatcccctacgagacatatgaggtgatggggagctgcatctctatcttgtgggcatctttgctgtggtttgagagtagaacaaggtcaaatcttaaacagattctaagtctctgctattcttgaatgccatgatcagacctagtacatatctgccagtctcctcttaaagggcagcccttgagctacagatggtgctttgagaggggtgcccagcagtgagtgcaggaacttttcaattgcctgactcgggtgcccctggatggcagcagttcctggaactcagctttccttcctcttctctcagaccaccatcattcatgctg

SEQ ID NO: 388588 - DNA, 4902 bp, Homo sapiens
  misc_feature (1646)..(1646): n is a, c, g, or t
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagtcctgccacctccagcagacctcagggagggttgngtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccgaagctatgtggcaggcttgtttgaaggacccagaggggcccagctgacctgtctcactgctcctggcagcccagccccatcggcaggtggcccctgcctgggggttattcgggacggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 388589 - DNA, 4244 bp, Homo sapiens
  misc_feature (1646)..(1646): n is a, c, g, or t
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagtcctgccacctccagcagacctcagggagggttgngtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 388590 - DNA, 3812 bp, Homo sapiens
  misc_feature (1646)..(1646): n is a, c, g, or t
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagtcctgccacctccagcagacctcagggagggttgngtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaaggaaggaacctggccccccttcccaggggggggagaagagaagcagcagcggaaacgaatacatagcgcaggaggacccaaggaagaccagcagattggaggcgaacgaagagcgggacagcatatacccgcaaaaagagatcaccaaaaaagggaacaaaggaacaacgccgaaacggagcaaaagggtcaaaaagagaaaccaactaacgggaaagggggagacgaaacaaagagacgggaaaaagaaaaa

SEQ ID NO: 388591 - DNA, 189 bp, Homo sapiens
tctggtcttttatttttcaaggtgtggtaaaaatgcaaggagatcagttaggaaattaaagccttctagctttctcagctgccagcttgagtgacctgaaggcgctcagctttcgccgtgatttcctttcccctcttggagttgagaagagtgattccgaccaccacgcgataggcagcacagcagagg

SEQ ID NO: 388592 - DNA, 4547 bp, Homo sapiens
  misc_feature (1291)..(1291): n is a, c, g, or t
attttcccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagtcctgccacctccagcagacctcagggagggttgngtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccgaagctatgtggcaggcttgtttgaaggacccagaggggcccagctgacctgtctcactgctcctggcagcccagccccatcggcaggtggcccctgcctgggggttattcgggacggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 388593 - DNA, 5247 bp, Homo sapiens
  misc_feature (1646)..(1646): n is a, c, g, or t
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagtcctgccacctccagcagacctcagggagggttgngtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccgaagctatgtggcaggcttgtttgaaggacccagaggggcccagctgacctgtctcactgctcctggcagcccagccccatcggcaggtggcccctgcctgggggttattcgggacggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaaaaacataaaaaaaaaaaacaaaaaaaaaaattgagaaaaaaaaacaaaaaaaaaaaaaaaaaaaaaaaaaaaaacaaaaaaaaaaaaaaaaataaaatcgggaaaaaaaaaaaaaaaacaaaaaaaaaaacaattttggccccctttgccccatgtatttttaatctgggccaggtttattctcgcggccgaaattcgggctaatttggccaattccccttttggggggggttttaacaattaactggccgggtttttaaaccggggggatgggaaaaaccttgggtttcccaaattaaatctttttgaaaaaaatcctttttttccaaggtggggaaaaacgga

SEQ ID NO: 388594 - DNA, 278 bp, Homo sapiens
gaagaagggaaggggagtccttccaggtatggccctggtggggcagcagcccagatgcctgcgttgccccctcacaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccagg

SEQ ID NO: 388595 - DNA, 697 bp, Homo sapiens
acaggtgcagcaggcaccgccggtaacccctggcctggcctgcgctgagccctgcaccagccgtgctgagggagcctgggcctggcccttcatgtgggatagaaacggccgtgccggtctcgatggtgctttggcagtttctctggaaatctgaaacctgcggtcttcagcccagccccaccctgggcctgcatgtggctgcgtgtcgtagagaaacatctgccctgatggtgacctgatgtgagcagcagtttcacagagtaagccacccctgtgcacgaggtctggaaaggtaagtgcgacgtcgagtcctgagcacagaagcaggtggcagaactgcatggcaggaggtgggcttggcgggccccttcctgacccccaagagccagctgccaccaggagcgtcctggggtctgtttccagcccggtggcagccgagcttcctgggcacccagctttccccagcctgctctgagcactggagttgagggcactgagcagagtggggctgagcccctggcggtggaggggacacatcagtgggtgttggcttgaggtggtttctgggaggctgctgggccccgatctaaagggacacacctggctgcacccacctcctgcagactttctccgtgggagaccaatgcaacaggcggggtggagcagccacgtggcagccacgagggggaaaggaagg

SEQ ID NO: 388596 - DNA, 414 bp, Homo sapiens
cctataatacctctattctttattatacaaaaacgaaagaaataaaagtctagcttcttgacctcaaggatcttaatataaggaagaaataatttttaaaagaggcttccctgcttaccttctcacttctcctgcaataaactgtccatattcttacatctggggatgcatactggtctcaatgtatgcatagtaaaatcacgatgcacagtaatatcaaagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttacgtatagggctttcttcaaaaaaaaaaaaaaa

SEQ ID NO: 388597 - DNA, 819 bp, Homo sapiens
  misc_feature (5)..(5): n is a, c, g, or t
  misc_feature (12)..(12): n is a, c, g, or t
  misc_feature (14)..(14): n is a, c, g, or t
  misc_feature (16)..(16): n is a, c, g, or t
gagcngccgccncncncatcggcatgtccccctggaactgcgacaacgcggcggcggcggcagcaggaccagcatgcaccaccgaaacgactcccagaggctggggaaagctggctgcccgccagagccgtcgttgcaaatggcaaatactaatttcctctccaccttatcccctgaacactgcagacctttggcgggggaatgcatgaacaagctcaaatgcggcgctgctgaagcagagataatgaatctccccgagcgcgtggggactttttccgctatcccggctttagggggcatctcattacctccaggggtcatcgtcatgacagcccttcactcccccgcagcagcctcagcagccgtcacagacagtgcgtttcaaattgccaatctggcagactgcccgcagaatcattcctcctcctcctcgtcctcctcagggggagctggcggagccaacccagccaagaagaagaggaaaaggtgtggggtctgcgtgccctgcaagaggctcatcaactgtggcgtctgcagcagttgcaggaaccgcaaaacgggacaccagatctgcaaatttagaaaatgtgaagagctaaagaaaaaacctggcacttcactagagagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttacgtatagggctttcttcaaaaaaaaaaaaaaa

SEQ ID NO: 388598 - DNA, 725 bp, Homo sapiens
attcacaaaacacttgaaaggaaggatagaatttgagctttatctttgaaatcgtgagtgatacagattaatttgacacttgagaatatcctgtttctggcttcttttttcccctgacacatttggctgatgcaaaaaaaaccacccacaatgttaatgtaacaggaaagaaaaatagtaaatcattaagaaggttaaataataaaacttatgtatattataagccatgcttttacagcatgtgaacagatgatccaaaacaatgtttgtacttggctttcaaagatgctttcatatttagtttgaactgttacattctggatttctcaaaagtttacatgatacatgtccaaacagcatcccagatactttctaaaactagctatatctatatcctctacctcgtcccctcatacatgctctgtatttgaactattctagcatgtcaaagctttatggaaatgaaaaataattcttcacaaaaacagaagaaaaaacaaaaggttgggaacctaggataaaaatgttaatagaaataatgcattgtctgtgtcttaaacttcacaatgattgcttgccttctctagtggtagaattaccattttgtaattataatcacctgctgataccctataattttttttctgtaggtgaattacttttcctttttttcccagaagttgataattaaggaatatatatagggaaaacacaatgggattcca

SEQ ID NO: 388599 - DNA, 809 bp, Homo sapiens
tatttttattaaaggaccaccctggctgtggtgagatgaatggattcaaacagggcaagaatggatacagggagataagttaggaagctggtatagaaatctggatgagatatggtggcttggatgatactagcagtgagtatgggaagtaggtggattactttacacttttttagatcagtctattcttgatgtcttgaagacaaatttaatttcatatataaatctaaataaaatatttatatttcatgtaaaataggataattctgaccaaatattagcaccttttctagtctcaagttctcagtgtggtaaaacagtatatatatacatattagcattgctgtcactctcttctcaaatatttttgttttgtttttttaacccaagacaatggaaggtaatacagagaatataggttttgtggtgtggtagattgaaagccactctagctatatggacctgaggcaagtacatttaacattttaaaactatttcctacttataaaatgatgataaaaatacgtagagttgctgtaaaattaactaaggtaatatgtacaaagtacctgacatatactgggtttccataaatgatttctatttttacatacctaataggaaagattcttctgtacaaaatctttttgatacttaagtaaccaaaataccttgtataggatataaaaaaaacttttgttgaattttgttgcatatgaaagtagtatgtttagatttacttatcagctactgacaaatagtttattttcttgtgaaaagactgtctgtagggtaattttagcaataag

SEQ ID NO: 388600 - DNA, 3817 bp, Homo sapiens
agatcttactccctttggcattttacaccttactcatacaatcatttttaaaaaatagcaatttaaaaaaatacagttcaagtgttcatcatatccaggcatgcaagccttttctaaatttttttaaataataaaaaagccccacagaggaaaggaggttatttgtgtcctcctgacacacacttttagattttggttaaaaagtctctagtgggtgcaaagtgaccccctttgtcactggaaacaaataggagcattctttgtgccactgtccacaaccacacagatatgtttcccaagggagctcatcaggtcttcaaacatttagcaagcatgacatgtgtaagagacagtattggagaagtaagacaagccttgctctgccgaagcttacaatccaggagctcaccccttcaaggaatttacagcctccagacagataataacattaggtccatgaaagcctacaaggcaagaagttcaggagagaaagaagtcataaccatcttggaagaatctcaacttgttttatcagaactcaaacgccaatttctcacccctagcttccctcattagcgcttattaactagtattgggaggaccaagcgaagagtaaagctagggtagcagaggccataagctaattgcaaaggacagagctaaagaaacatgctagtttcccctgagcacccaactgcatgactgaaaatggattaatttgtatttctaatggatatacaagaaacacgtgaatatgctaaaataaatttaaggtcaagcaatgcaaagtgttagtgcgtttgccttccactctcagaggcagcctctcttatttggttcttgggctgcttcataaaaagttctgtgttttttaatggcctcagcttttgggaggctcaggccacctagcccatcaggagaccaggcccgaaggatggatctgaagagtgggcaacggagagttaaaccagggctgacttcaacaggcccagtcaagtcaggggcaagcacattgtccatccactggaagacggaaaggggagaggaaggcaggccctcccgactcacaggtcacctcgcaactttgctaggcactacccaccctttagggataagtgaagtatgtggtgggcatacaaggcgcacaggggagtcattctggcaaattccaagaaggttttaagggctcccgaggcaggcaggcccagttgctgtttggagcttcctttggggtgggaggatggcgggggcagggggccggggcggtgccttaacgaggggagatgcttttaaatagctgccttccaaaaaccatcctccctgcttctttgagaagcacccagctgttgtttaccctccaggacagcaaatccggttatttgtctctctattccgtgatattataaagtaatgaatggtccattaaactaagtttgggatcccgtctccccacagccacctcctcgccggcaccctcagccggggaggccgtaggctcggctgcagcctggcagcctcagtccccctccctccaccatttccccctactccctccctctcctgcaccccctccccccggttatttgggagattagagttcattaattaaatcctgtgcttagatcgaactgtaacattattccaatcacatttatcttgcaggcggcggaggagatggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctccccccacccccgcccgggtccccctcctccgccacacgcgcgcgcgctcacacacacacacacacacacacacacatatatacacgccagcgagctgctggccgctcaatggaccgatttccccggtttccctgaacccagcccagcccgggatgagaaactgcaaaatggcccgggtcgccagtgtgctggggctggtcatgctcagcgtcgccctgctgattttatcgctcatcagctacgtgtccctgaaaaaggagaacatcttcaccactcccaagtacgccagcccgggggcgccccgaatgtacatgttccacgcgggattccggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggtactggaaaaacaaacatttgtcacctaaacggctgagcacaggtattcttatgtacacccttgcatcagcaatatgtgaagagatccacttgtatggattttggccgtttggatttgaccccaacacaagggaagatcttccataccattactatgacaaaaaaggaaccaaatttaccaccaagtggcaggagtcccaccagctgcctgctgagtttcagctgctgtaccgaatgcatggggaagggctcaccaagctgactctgtcacactgtgcctaagaactccaaacggaaagtgccaaatggctgtttaaaaagtgccccaaatcaaattgaatagccttcagaatagaaccctagagaatgtcttataaggattgtctgccatttaaaaggaaagatgtcttttctcttttgcactgctcttttaagagttttagcagatttagcaggacagatgcattgaagccacatggtttagacttgattgataaagggaatgttgcatttgggactatgctgctaacgaaatggtttgaagtattttcatgtttggattttaataataaactgcctctcatttttatgaggactagagctatagtttctgcagctctgctcagatagtcctcataatcagaggcctctggccaactggggcaggacctgttttgctggtgggatcagactctgaaaaatggaaacgtaaaaaactggtttgcatatctcatcttctatctatctccctatctccatctctatcaccatctcactccctccctctgcaactactccctgccctaccaccgtggagtttaataatttgctaggaatcctattgaattcgctttgcttgtatatgttgcatttgtacttgatgtgtttaaggttctgggtaactttgatgcttcatgacaaaataggcaaatc

SEQ ID NO: 388601 - DNA, 3119 bp, Homo sapiens
agatcttactccctttggcattttacaccttactcatacaatcatttttaaaaaatagcaatttaaaaaaatacagttcaagtgttcatcatatccaggcatgcaagccttttctaaatttttttaaataataaaaaagccccacagaggaaaggaggttatttgtgtcctcctgacacacacttttagattttggttaaaaagtctctagtgggtgcaaagtgaccccctttgtcactggaaacaaataggagcattctttgtgccactgtccacaaccacacagatatgtttcccaagggagctcatcaggtcttcaaacatttagcaagcatgacatgtgtaagagacagtattggagaagtaagacaagccttgctctgccgaagcttacaatccaggagctcaccccttcaaggaatttacagcctccagacagataataacattaggtccatgaaagcctacaaggcaagaagttcaggagagaaagaagtcataaccatcttggaagaatctcaacttgttttatcagaactcaaacgccaatttctcacccctagcttccctcattagcgcttattaactagtattgggaggaccaagcgaagagtaaagctagggtagcagaggccataagctaattgcaaaggacagagctaaagaaacatgctagtttcccctgagcacccaactgcatgactgaaaatggattaatttgtatttctaatggatatacaagaaacacgtgaatatgctaaaataaatttaaggtcaagcaatgcaaagtgttagtgcgtttgccttccactctcagaggcagcctctcttatttggttcttgggctgcttcataaaaagttctgtgttttttaatggcctcagcttttgggaggctcaggccacctagcccatcaggagaccaggcccgaaggatggatctgaagagtgggcaacggagagttaaaccagggctgacttcaacaggcccagtcaagtcaggggcaagcacattgtccatccactggaagacggaaaggggagaggaaggcaggccctcccgactcacaggtcacctcgcaactttgctaggcactacccaccctttagggataagtgaagtatgtggtgggcatacaaggcgcacaggggagtcattctggcaaattccaagaaggttttaagggctcccgaggcaggcaggcccagttgctgtttggagcttcctttggggtgggaggatggcgggggcagggggccggggcggtgccttaacgaggggagatgcttttaaatagctgccttccaaaaaccatcctccctgcttctttgagaagcacccagctgttgtttaccctccaggacagcaaatccggttatttgtctctctattccgtgatattataaagtaatgaatggtccattaaactaagtttgggatcccgtctccccacagccacctcctcgccggcaccctcagccggggaggccgtaggctcggctgcagcctggcagcctcagtccccctccctccaccatttccccctactccctccctctcctgcaccccctccccccggttatttgggagattagagttcattaattaaatcctgtgcttagatcgaactgtaacattattccaatcacatttatcttgcaggcggcggaggagatggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctccccccacccccgcccgggtccccctcctccgccacacgcgcgcgcgctcacacacacacacacacacacacacacatatatacacgccagcgagctgctggccgctcaatggaccgatttccccggtttccctgaacccagcccagcccgggatgagaaactgcaaaatggcccgggtcgccagtgtgctggggctggtcatgctcagcgtcgccctgctgattttatcgctcatcagctacgtgtccctgaaaaaggagaacatcttcaccactcccaagtacgccagcccgggggcgccccgaatgtacatgttccacgcgggattccggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggttctttgcaactttacattgctgtaaacagtgctctgatgaacatctttggaattaaatgtttgattatttccttagataaatcccttgaagtggattttcaagagaaaacttaccaacaagttaggagaaaaacatgcatcatcattaaggaagacttcctcaacagaaggattatgcattattgtgtactaaataaggaaaataaataagctattgttgtgtgcttcttcaat

SEQ ID NO: 388602 - DNA, 426 bp, Homo sapiens
gacggccattttatggtctctccggcacccggagggatggacaatgcagatggggttccctagttttctttttttctctcgggtgtgtgtgggagcagagggtggaccaaatgagaggggctccgggacggaacggagcccgcacgcgtaccagccgccctcgccccagccgctgcactttaatggctacctcggcttccccgagctgaggccagcacgcttgtctgtgctcatgctcctctccaggtcacaatttgcgctgaagtttctagacccgtcattcgtgcccattacgaattctctcacccaggaactccaagagaaaccttctaagtggaaatttaatcggacagcgtttttacatcaaaggtaggataggaggaaaagatccaaaaggtgcttttaagaattcaagagctcaaaaca

SEQ ID NO: 388603 - DNA, 1948 bp, Homo sapiens
cggccgctgtccgcggtgctgattccctggtcctcgcagcgccgcgggctccagccctgcgcccggcgtgcgccctgctctccgcatgacggccattttatggtctctccggcacccggagggatggacaatgcagatggggttccctagttttctttttttctctcgggtgtgtgtgggagcagagggtggaccaaatgagaggggctccgggacggaacggagcccgcacgcgtaccagccgccctcgccccagccgctgcactttaatggctacctcggcttccccgagctgaggccagcacgcttgtctgtgctcatgctcctctccaggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggtactggaaaaacaaacatttgtcacctaaacggctgagcacaggtattcttatgtacacccttgcatcagcaatatgtgaagagatccacttgtatggattttggccgtttggatttgaccccaacacaagggaagatcttccataccattactatgacaaaaaaggaaccaaatttaccaccaagtggcaggagtcccaccagctgcctgctgagtttcagctgctgtaccgaatgcatggggaagggctcaccaagctgactctgtcacactgtgcctaagaactccaaacggaaagtgccaaatggctgtttaaaaagtgccccaaatcaaattgaatagccttcagaatagaaccctagagaatgtcttataaggattgtctgccatttaaaaggaaagatgtcttttctcttttgcactgctcttttaagagttttagcagatttagcaggacagatgcattgaagccacatggtttagacttgattgataaagggaatgttgcatttgggactatgctgctaacgaaatggtttgaagtattttcatgtttggattttaataataaactgcctctcatttttatgaggactagagctatagtttctgcagctctgctcagatagtcctcataatcagaggcctctggccaactggggcaggacctgttttgctggtgggatcagactctgaaaaatggaaacgtaaaaaactggtttgcatatctcatcttctatctatctccctatctccatctctatcaccatctcactccctccctctgcaactactccctgccctaccaccgtggagtttaataatttgctaggaatcctattgaattcgctttgcttgtatatgttgcatttgtacttgatgtgtttaaggttctgggtaactttgatgcttcatgacaaaataggcaaatc

SEQ ID NO: 388604 - DNA, 230 bp, Homo sapiens
  misc_feature (223)..(223): n is a, c, g, or t
ccacagcatggtgggcagtcatttgtaacccacagaacattgagtttctaaaatttgagtgtttttaacttacgaaggccaactttactgatgaagtgattaccccaaatatgtgaaatccatatttcaagtacaatagcaggaaatcggaaatgggtaggtatatttctgactgtcaaagagtacaaagtaaagaggggcccctgaagagtgacactactgngaaaaac

SEQ ID NO: 388605 - DNA, 352 bp, Homo sapiens
agacttatacttgtttgtggtgttctttcagacttattttttaaattaaaaacattgtttttagagatggggtcttcctctgtcatctagccttgagtacagtggtgtgatcatagctcactgcagtctccaactcctgggctcaagtgatccgcctgcctcagcctcccaagtagcttggactacaggcacatgccaccatgcctggctaatttttaaaacattttttgtagagacaaggtctcgctatgttgcctaagttggtcttgaaatcctgacctcaacagtcctcccaccccaccctctcaaagtattgggattacaggcatgagccatcgttcccagcccagcc

SEQ ID NO: 388606 - DNA, 378 bp, Homo sapiens
atgatttcattggcttgcagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcaga

SEQ ID NO: 388607 - DNA, 443 bp, Homo sapiens
tgtgagagtatattgatgagaaaatggcagcctgtgtcagcatttcaagccaatatatgtccctttattcatttttttaataccacctcaagaacattttcctaatttgtaatatgcaaacagagataagagtttgaaactctcatgctggacttttctcattttattatgaaagaggaacagtaaccctggccctttcctactaccgaagattttgtgaaaacagccgctgtacaatctctaggtaaaccataagaataatgtaaaactctccctcatctcctaatcagcttatatgtttcttaaattctctctggattctgtcctcttccctgcatctctatttcctgcacccaagcaggattctctcatcttcacaaatggtttttcagactcggatatttggcagacatttttttcagaatgaagtaagactgacactt

SEQ ID NO: 388608 - DNA, 404 bp, Homo sapiens
actggtaatgtcggcacacatgcagcaacatcagactgcactaatagtcactgtgttcctcagagccaggcactgtcactcactgtaaaaaagcaaagccaatttcacttgagaattttcctaacaaggcaggaaacattattgactttattgaatttcagctacaggacacatcttttgagtgttcagtgctatgaagtgggaatccctccttcattatacgggtgtacattgacagtcttcaggaagagcacttgtgagattgtttggtttgagcttacctacatgtttttttctttcttcatgaaacatcatttttacttgaaagaatagctgacaaactggtttttcagactcggatatttggcagacatttttttcagaatgaagtaagactgacactt

SEQ ID NO: 388609 - DNA, 478 bp, Homo sapiens
catcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttg

SEQ ID NO: 388610 - DNA, 319 bp, Homo sapiens
gcctcagcctcccatgtagctgggattacaggtgtccaccaccacacctgggtaattttgttgtatttttagtaaagacggggtttcaccatgttggccaggctggtctcgaactcctgaccttgtgatccacccacctcggcccccaaagtgctgggattacaggcatgagccactgcgcccggccctctttttttttttaactgatagaaaacctatctagccaccacaaactggtcaaggaagtacaactcaaaggccaggaccaggctttccatggactgaaataattaaatcatttaattatatcagagttaaa

SEQ ID NO: 388611 - DNA, 466 bp, Homo sapiens
gagggtcgcatcagacaaacctgcctcccgttttattcttcaataagatagctagaaagttcaaaagagctacatacccccctcacaatttctccacaagcaaattcctttcgggcctcaagatctttgccctaaaacagttctgatgaattttccctggcaatgtaaattgatagcttatcttcacaggtacaatgcagaaagtcagccctccgctcactgaagacaaatgcatatgtgatttcttcctctgtcctattgtttatacaaaatgcagattcactgagccagacagtgagtaaggcatatgtgactattcctctacccactctcacatgtaaattgtgtattcagtgaaaggctgatcacagactcaaaagaaagcaaacttttggccgggcatgctggctcacgcctataatcccagcactttgggaggctgagatgggtggattacctgaggtca

SEQ ID NO: 388612 - DNA, 363 bp, Homo sapiens
ctccagcctgggcgacagagcaagactccgtctcaaaaaaaaagccttccttgccaggtgaaagcaagagtggtatggaacatttatttaaacataagaagcagaaggttcctcctcttgcaagtatgttttctctaaatgtagcatttccactggaggaggtggtctgggtggatggttaatatgtgaggattgtgcagccaggcagataaccaggcctctgcatatacagatacccacagcccaggaatcttgagaactgaatggcccataacaacctctggcactatcggagctgcagggaggcttggctggggctactccagtctcaggcccctgtttttagcggaagtcacaaggagg

SEQ ID NO: 388613 - DNA, 231 bp, Homo sapiens
aagttttatttgtgaaattaccttacaaatgttagagaggtttaaaaaaaatctctgcttgtcttttctcttgttttatcctgtcttattcttggaaaagttaatatttgagaatagctagcatgtcctattaatcccttttttagaaaaggacccgctccgacaccagttggcagttaggtttcatcagtcactcgagattatggattaactcactgatctttttaccct

SEQ ID NO: 388614 - DNA, 272 bp, Homo sapiens
catgattttggtttgcttggttttcttatcctttgaagtaagacacttcatgattgtcatgagtttggttcccaagggtgtgagatttataggaaccaagacttttacagtaaagagatgatttaaaaggcaaaccactaaaaatgacagtatgaaactaaaacgtttccaagttgctttaatccctgaactaatccttgcagaatgccagggaaagaggatgggaggtaaaggtcatggttaggaagagaaaaagagctaacatttactaa

SEQ ID NO: 388615 - DNA, 269 bp, Homo sapiens
acacaccttattttaacaacaacaacaacagcaacaatgaaggtgcggcatgcaaacacccaaagcctccccacaatctgttaggaagtgtatcagtggacacctttatctagagggtcccgggatttgtggaatggaagataaatggcagcaaatccaatgccagtcctcctgaaaggcaggataggtcatgattgctgagtcataaagtcacccctcatgactcagcaaaatcaatttaggaaggcagtggctcatcaagctcttgc

SEQ ID NO: 388616 - DNA, 86 bp, Homo sapiens
  misc_feature (2)..(2): n is a, c, g, or t
gnggggaggggtctgtgtaggggacccccatgctgacccagtggctgttttatcctgtgcatataaatacaaacagcacagtgcac

SEQ ID NO: 388617 - DNA, 373 bp, Homo sapiens
tccttcaatatgattaactacaggcatttcaggtatctgctgagcagaataaaggactacctttttatgtgaagtagttgtctaaagatcagaaataattgctttgtacattagccttcatgacctgcttgacctagttaattaattttttgctagcataataataatagatatatattggagatatgtttcatcattaagtatctaattgacctctaattttaagagctgcaccttccatttattgtcttttggaaatggctggagcacccaacagaaaaaccgaggacagtcagaagctgacttcaatcccacatagtccctctgtcttaggttgtatttctttgttatttgtatttatcattgatgaaca

SEQ ID NO: 388618 - DNA, 848 bp, Homo sapiens
atctcattcaactttgtatcacctgagcttaactaacacctggcacagagaagaaacatattaaggatttgctgagagaataagatagtataacttggtcttatatctaaggtttgattttctaggaacctatagtgaattttaggcttgcttttcagtttttgtagcagggatgtagcacaggtttgggactcagcacacctagtctgaaagctgatttctgtcacagcatgcatgagggacagtctcttcagtttatttataccttagtgctgtgattctcgagcttatagacactgtgaggacagaattttagctctttaaacaaaggggggcaaatatacagtgacctctatctatgtaggtatttaactgaaaggaattccagggccaagtgtgtctactattaaaagaaacgtacttttcttacaatgtagtccctgaatgcaaatcatggttttatctggtgggcaactgaagaaacagcaatctgaactgatatgggaggcagacctcactgtaacaggattagtgagaaacagtgtttgtggctcttaattgctcatttttttttttttaatgggggatgttagggattttctaagggcaggtttatccatatgcagagttgatgttaggatgtaataccacaaagatgtaattaactcctctgtttgtggtctccatgttaattcactctcataagagggtatgcagtgtggtcactattctaccaccatttttaagaaaaaatttaaaactattttttatcttccaaattaaatattttgctatttgataagttaacaatgcaacagaaaatcaatataacttttatctttaccaga

SEQ ID NO: 388619 - DNA, 613 bp, Homo sapiens
gctgtagacatatgaagtaattgttctagctttaaatcatcttatcatagaatatttagtgacctgaaaaacatttgtcagtgacttgtaaatgaggaaacataataacaatgaagttattgctagctgctgctgttggaatgtaccatttgcaaaaattgagaggaaaccttaataaatttaaaggagaaaaaaaatacagaaattgcaactggatctgacattttttttttaactgatagccctacatcatcaccctgtgccaaaaatgtggaattctgtcactaagtttgtagtttcttctcatgagaaattggtttcttaatttataaagttgacgttccaattttgtatgtctggttttatttgtaactcatttttattatctcataaacatctcagttatactcttaaaatggggagcctgttgactttggcacatctctgtaggggtgatggtgaatttatttgtcttggggtccagaagtgctagagggccagtgtgtgcaccagacgtagtacctaacttgatttacatctgttccttactccagaaccctgatatgagttgaaaagaattgatgactagcagtgagaaagaatggagcccttc

SEQ ID NO: 388620 - DNA, 498 bp, Homo sapiens
gagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccactgttcctgtgtcttcacgagctgtcccttacaggcaggggcttcccacaggctgggggcctcggggcggggagcatgagctgggctggcaccacgactgagggcttccggcccggcttcttccccacagcaggctgctcagagggggtgctgccgggactgccatgcccacctgagaggggcctgggggtgcgtcctcggccggttagggaatttggggtgaggttcctcaggagccctcactctgcctgtggacgctgcacctgccacttaaagaccccaaagactctgttgggaactgttgtcaataaaatgtttctgaggatg

SEQ ID NO: 388621 - DNA, 931 bp, Homo sapiens
tggagttttaagggcaggggaggtgtgaatgccatatttgtgtcttggaaagatggctttggctgcatgacagcatttggattagagatgtctaagaatggaaagaggtacacacattaggagactgcagttttggtgagaggtgatggaagctcgagactagtgaggaaaagggaggtgtcaacatgagccctagattcttggagtccagaacttgaagaaaaaagagtatttttgtaaattgacctttgttaaattttagggcaagatgtttcaaaattaccctcttaatgacttattttttaaaatagtatagactgcaataaataagaacgaaagatcagacattttcatattaatgtactagttggtgttataaacttctatcatcacttctaaaaatgtgtttaatttattatactgaaatgaggctgaagggatttataacttcagtaatttgaaatgcggtggattttgcttttgtgtattatctttgtttcaacaactgtggttttatttcccctcagtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttggggtaagtgagatatgactt

SEQ ID NO: 388622 - DNA, 793 bp, Homo sapiens
tccatgttgagttaattttcatgtgatgcgaggtaaaagccttaagtgtatctccttgtgtgtagatatttacttgtcctcgcaccgttagttgaaaatactattcttttcccattgaaatgcctttgcccctctgttcttataccagcaccacagtgttttgatactgtggctttatagcatgttttgaaattcaggagtacaagccctccagctttgttcttttcaagattgattttgctattctgggtcttttgcgtttgatataaattttggggctggcatcagaaaaatggcagagttttagctccaaacacccatttctccacagaatcatcaaaaaacaaataggaactatcagaatgaactttgtcagaactctggaaaacacaggtttacatcagtcaggtaaacaatagataaagaaaaaggcaaattaaaaatggtaggaaagctgtgtggtgtttttacttgtccttgcccatcccctttccaggtcaatggcaatcttgaagaaagcaacctgcattgccagtgtgggaccctggtctctggttctaaagggagcagagcagaccttatttgcaaattattgtggtctttctattttaacctctctgtggctgcctgaagggctgacacagagtgcccatctgtgttttatctaactcagaattcacctaggatggaaaagtggtgagcattgcttggaaacattataaggagaacaaaaaaaccacaactgcttggagcaaaagatgatatacacaatctaaagcctgggaggaagaac

SEQ ID NO: 388623 - DNA, 2430 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaata

SEQ ID NO: 388624 - DNA, 2685 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388625 - DNA, 2303 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaatggattggttttcaacatcgtgcctgccgatatgcctacagaatcatctaatcatcaaaaaacaaataggaactatcagaatgaactttgtcagaactctggaaaacacaggtttacatcagtcaggtaaacaatagataaagaaaaaggcaaattaaaaatggtaggaaagctgtgtggtgtttttacttgtccttgcccatcccctttccaggtcaatggcaatcttgaagaaagcaacctgcattgccagtgtgggaccctggtctctggttctaaagggagcagagcagaccttatttgcaaattattgtggtctttctattttaacctctctgtggctgcctgaagggctgacacagagtgcccatctgtgttttatctaactcagaattcacctaggatggaaaagtggtgagcattgcttggaaacattataaggagaacaaaaaaaccacaactgcttggagcaaaagatgatatacacaatctaaagcctgggaggaagaac

SEQ ID NO: 388626 - DNA, 3053 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagtgtgctccatacatgaaagttaaggagaaattacttttactagttggtcccagaggaaggaatcccttctctgttcaaaaaaagtgagatctggtcatgctgtggggaagacgtatccgaataccgagctttcttgctgtcgacagcgggagagaggctgaggcctgtgtgtctccttcactgacatcttgacatctcgttaatatggaaatagctcaggttgagctacactatgggttgtaagaaggtttggagaacacaaccattatgggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388627 - DNA, 2331 bp, Homo sapiens
gaattgcgagctgcggtaccccggcgcaattgcgtggtgtctgctgctcagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388628 - DNA, 1960 bp, Homo sapiens
gctaatccaaatgttacaatagagtgagcaccgtcaccagcccttttctactttgcgtttgtcagttttcatgtcataaagtcaggtaatttattcttgttctggttatgttaaacgtttattagtatacatggaaattggtttttgtctttgtgtatagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388629 - DNA, 2032 bp, Homo sapiens
gggagtcatatttgttttacactaacaggaaactatgaaaataagtagatgagtttcagcattaaatttcttcataatccagtaagtgagtagctgctataaagagctgagtcagtcactgtacatgcattcaaggagcctctctgtataagcacttgcgttaaagctctgacctcgtttttatgtcattacagctaaaatgaataaaaagtaaaacactgagtctttgagagggcagttacagttcagatctgttagatacctataatatactcaaatgcagaattgtaacggtaattctgttttaaaatgtgttattcatgtgtctactatattttaatgtctgtttctgtttttagggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388630 - DNA, 1903 bp, Homo sapiens
gctaatccaaatgttacaatagagtgagcaccgtcaccagcccttttctactttgcgtttgtcagttttcatgtcataaagtcaggtaatttattcttgttctggttatgttaaacgtttattagtatacatggaaattggtttttgtctttgtgtatagggttatatggaaaagattaaaccaatggtgagagatggagtttattttctatatgaggccctacatggaccgacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388631 - DNA, 162 bp, Homo sapiens
taccttagcaatcttcagggtgttgccattaaattcctgccccgcactttcttaggaaatactccagaaatccagcctttacctaccttttgtcttacattcagatctggtcatgctgtggggaagacgtatccgaataccgagctttcttgctgtcgacag

SEQ ID NO: 388632 - DNA, 358 bp, Homo sapiens
ggcatactgtcctgtgctgggtcttatttgtacatcctgtttagaaatcggcacagtctgctaacagaatagagaacagcaaaaaggcacatagggaaaagttatggtgatactgagaaaagtaggggactacctgttttaatcccaacgagtgaacattagagatgaattgattcaattccttttctctttgtattctcctagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaa

SEQ ID NO: 388633 - DNA, 2783 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388634 - DNA, 2555 bp, Homo sapiens
aaaaaaccttatcgggctaggtacgaggcctggtgttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgtttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagt

SEQ ID NO: 388635 - DNA, 1870 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccaggtattttcttttaggcaatatctaaaggatattataaggtgaatgtattagagcagtttcataaagctcttccatataatttgtgatagatagcgacaggtttgatatgccctttatgattagtgcaaatttgctcacttattattagttatttggttcatagctaatacttatttaggtgttgggtcacaacaagcatgtgctcaaactcaaaagaaaaaacatggacctctgagcctagccatacagctcttgagtctcatcttccctcctttgaaagcaatttccatggaggtgtttcttccttccttggggaagtatgccactcttgagagtgaataagaagaggggtaagaagagcccttgttaagctggctctcag

SEQ ID NO: 388636 - DNA, 727 bp, Homo sapiens
tgcacgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggcggccgctcgcgatctagaactagcccacgcgtccgcgacccacgcgtccg

SEQ ID NO: 388637 - DNA, 144 bp, Homo sapiens
gcccgcggctcgcggacctgcagcccagcccggccgcgctgcgtgccccggcgcgcacccctcccactcccatccactcggagccacgtcccctgcccggctccggccggctcccaccgtccccggccaccgtcttcgcccctg

SEQ ID NO: 388638 - DNA, 561 bp, Homo sapiens
ccatccaggctgttaatttatttggtcaacagtttcgtgatttccatatggtgctgatgtctttgttagctcttcttcacttcctgcatttatttttatgtggcaggctgcctagtccctaggggaatagctgagtggtaggaggggttgtgatcttttagcaagatttcaaaacagaataatgtatgcatgtaataaaaacaaatacgctcactcacagtgcaaaaccaaaaagaacacccaaatccctggaacttctgtgctactaagtcttttgttgtaggctaagattattttccttttggggttaattatttctgccttaattattgactgttgtgaaatctctcttctgagacattcccaaattttatttaaactagtgggtaccagctgtactgaaaccataattttagccatgtatttttattagaaaaatgtttccaggggattaaggaattttaatatttagtggaagttttaaaaaagaatgtaaaaatgccttttggaacctaagaatagttgtctattttagaaaaatcagaaatattgatggagaaa

SEQ ID NO: 388639 - DNA, 515 bp, Homo sapiens
tttccactgcatgcctgatgctgtcagtagcagatcctgtttcaaaaacagagtagaggccactaggcacaaactccctcagcttcctcccctcaccacataaaaatgtcctagtacctttatattaacttcttgtctgtcccagagaaagaggggtcccgattccaccctcagacttagcacctccacctgtgatttttgtttctatttcttactgcttttaattgtgaccctgctaaatctctcggaaagcttgtaaaagcagtgattgctggaccttacccacagagtctctgattttagtggcttgggagtaagactagagaatttgcatttccgacaagttgcctggtgatgctgcgctgctgtctggggaatcatacttggaaaatcattgtcttttagatagtgcttgtgctttttgtttgtttgtttgtttttgagacagggtcttgctctgttaccctggctggagtgcaatggtgcaatttcaacttactgcaacctctgcttcc

SEQ ID NO: 388640 - DNA, 442 bp, Homo sapiens
catggttccaaaactggcagttgagccaagagatcaattgaaatgaaaaggcttcttgaagtgaaggtccaaagtgctagctttgcattttggcaatctagagcaattgtattagtgggccagagttcttgagtctaggcaggcgtgccagacagattctttatactctcctgctactgacctggcccactcagactccatccctgacactgtcccattacaataaaacaagttgcacagaaataggactgaaaatatcagtaaccatctgttttccttatcatggtggggacatgagcttcagcttttggattcaggaccacaggtatggcagagaacaaagtatatttagtgaaccataaacactgggattcctctgtgtgccagacattactctagatgcaaggtctctgttctcctggaacacgcattccagacaaga

SEQ ID NO: 388641 - DNA, 318 bp, Homo sapiens
ccatctgacacagagtcccacaggaatcagcttgcagtgggctttataatccaaagttagcattatactgcagtgtttcctcccatggttcaaggaaaaaacaacctgaagtggggcttttctatttatgagagaagatttataagtaattcaaaagtggtatttactatcagaagtcagagatcacttctaagcatatcagtaaatgccctcaatttggtatccacatacttttaacttggaagatttgttatgagcatccccctttatcagtatgacttctttctttgtgctctcttgagaagggaaaagatgaag

SEQ ID NO: 388642 - DNA, 619 bp, Homo sapiens
taagtagtgaatatatttatttgtaagactaaaagtagactcagaattagtctgaaaaccacagtagtactggttttttttacacctgtatttgccttcgttttcttttctttgtatttcatgcatctcagcctcttctctttttgtatttcatgcatctcagcctatgcttctcttcagtgcgtgcctgtagtgcacataagtcttctaaggatcaactttgtaactgaaccaactggactcctgtccaggagtttatacccttcttggcatctctcctgcccatttgtttaatctttccaactcatttgatcctctagtattagagctgacagctgcagttgcatatggagttcataaagtagctgaataataaaatgtcatgacccagttcttgtatagtttcactgatgactaaattggcaactcttttaatattgaaatgggaatgatcaagctgtgtacttttctttggaagttcacgtatattcaatgagtacttttacctcctatgactttccatagcagaaatgctacagacttatttggcaggtcaggtggaacattatcttgattttataattatcttgattttacaagaggaaagtttatgtataaa

SEQ ID NO: 388643 - DNA, 555 bp, Homo sapiens
aaggcaatgctgagataatcgagggtactcggttgaggatactcaccagatttggctgctttctctcctgcttccccagagtctggcctcttctggttttagcatcttcattttctgcagagatggagtctcaccatgttgcccaggctggcctcaaactcctgagctcaaggaatcctcccaccttgacctcccaaagtgctgggattatagaaatgagccaccatgcctgggctcccaattctcgaagttggagaaaatggaaaaaaggtgatattgatgatctttcctgagtcctattatgtgcctgacattgtttgagaagctgaacttctcaagggagagatctgttcttcagaccagagggaaatttggaagcccaaatagagaacagtatttctagatctgacctttagactataagaggcacctaattccttaaaatagaatattgttgcttttcattatgccatgcacatgataagggctctgtatatattttgggatgagggcaatagtattgtccatgtttctctaaaataaactggtaaaact

SEQ ID NO: 388644 - DNA, 292 bp, Homo sapiens
tctaatcataagcatgtaaatcttgcaaatctcctcaccagaaggtggtgactgtgcttaatataatgcccaaagaagccagaatgtgttttcctcatccattctgcctagcatagtctcatttcatttcccacactgtatatccactcagcattttgctccctaactgtgtttgtgcaatttactcttatttacatacccaacaagattgcctacagattctatctgtctcaatcttactggactttttaaagctcatatcaagtgtttccatccatgtcatattttctat

SEQ ID NO: 388645 - DNA, 662 bp, Homo sapiens
agcccgctctcagacccaggtctgtctgactctaggcccatattcctcccatcatgttcttctgcctccccctcttctcctgaactcttctcatcttaaggacttcattcttccctcctaagctctggtaatttaatatgacagtctgggagttactcacttttatggaagtgccgacacatttcacagacctcttgcacagtgtagttgactttcccagaagcacatctctctggagcgggaggcagcagcccagaaatgctgtctcaggaggaaaattgacatttggagttggaggtttctaagtgggatgcagaccagtgctcttcagattgttctatgctatgaccttttcccgtggcgcacattttctccactgtagagatagcgagggcttctgtattgcagagagcactgtgctttgaagggccagctttgtaatagtaaaagaggagaggcaaaggggagagggccagcaggcctgactccttggcggcagcaggaattgggctccagtcacttgcttaacactgagaaaaaggaaagaagacaggtgtgtttttgttcttaagtctcttgctttctagtggagaacattaaattaacacccaaaaaacagagaatgatgaaacaataaattgtgaggcactatgtagtaatga

SEQ ID NO: 388646 - DNA, 289 bp, Homo sapiens
aagtaggatttgctgctctcaaacaacttcaacacaggtgagggatggttccccgtgagtgaggggcaggccccaggcccggtacccaggtggtgccacacacacctcacaggctgctctgcctgcaggcctctcactgcactcatttccaggatggggcagtcatctatgcaactcccactgtgcctcacaccctgcctcatgcagaggagaaggtcgacgcagagcagaaaggtcgacgcaaagaagaaagggtcgaacgcagagaagaaagggttcggacgccaga

SEQ ID NO: 388647 - DNA, 236 bp, Homo sapiens
  misc_feature (213)..(213): n is a, c, g, or t
  misc_feature (215)..(215): n is a, c, g, or t
tatataggtcctttgtccattttttaatcagattgtgtttctttttgctgagttttttttaacatattctaacaactagaatatatagagaatatagatacataggtcctttatccattttccttttttttttttttttgagatgtagtctcactctgtcgcccaggctggagtgcagtgagtcgagatcgcgccattgcactccagcctggncnacaagagcgaaactctgtctt

SEQ ID NO: 388648 - DNA, 445 bp, Homo sapiens
cctgaggtcaggagtttgagaccagcctggctaacatggtgaaacacagtctctactaaaaatacgaaaatgaactgggcgtggtggtgggtgcctgtaatcccagctaattgggaggctgaggcaggagaatcacttgaacccgggaggtggaggttgcagtgagctgagatcatgccattgcactcctgtctgggctataagagcaaaattccgtctcaaaaacaaaacaagacagacaaaaaagaaataatccacaccctaaagtgcgattcagctgaaattgtctatggtattttgcctagaattaaccaaaagagctggggtaggggctggtggcgcatagctcagcattacagatctacttaaatcttgtaaactatttataggtttgggttgttataacatgtttagcatggttaataagccaatcaagaaatatccc

SEQ ID NO: 388649 - DNA, 365 bp, Homo sapiens
cacagagtaataatgaactatttctcatttgtgcccagttttttgcagaagttttttaaatggggattaacctcctcacagtatcagtccatggtggttccagcatagtctatacccaaaaccatgtttagaaccacttgagggaagctcagaaccaatcaaggctatacccaggacaatctactaaaccagaatcttccctcaggtcaaaagctaagcattttccaggctcccaaagctactctgagtcaatggaacttacagtgatgtgtggcagcaagtcagggtagcctctaattcctatacagagaaagatgttttctgaaacaaaattcaggtcacacttcctgacaatagagaatatt

SEQ ID NO: 388650 - DNA, 389 bp, Homo sapiens
gtgtcatctggcttcgttcagtctatcttggctggtgccactgtcctcctgggtgtgtgtcttggtgacaatgggtttgagcgtgcagggttaccatccaggtgagtgtctggattctgatgcatctctgcaacagaatttctcagcacagggagtgtctgtggctgtggatcctgccagctgtggctctgacaggaggggtctctggccctatctccaggacccaggggtctctctgtcccaggaagcatggctctgttaacagtcccggccgcgctctaggtgtgtggccctgcagttgtgagtttgacccagtttccatcactgggtgatggtctggctttgtgcttttcctctttggctccgtgccttggggccggattgtgttt

SEQ ID NO: 388651 - DNA, 789 bp, Homo sapiens
gttgccccccacccccaccccttcaaatatagctgaagaatcactacctgaatagcctggctcagcctatctgcttcaattcattcctccttccccttgggactggacaactggaccctgcccttgcttagttggagtcagttgtgtgtgtgtgcaagttggtggaagatgtaatattttcagatctcaagaacagctcatgtttgtagtgtgctgtctcagacttgccagaataatagagctttctaatgacttaagcctcactcttatctcctattgagattttagtgcagtgttttcaataatcgttcatttgtacttcctgtgctgtgatttcagagtttgctgttcagtcaccgtggacacttttgttacttattctatcaatcttggatcttgcattcaccatttggagttaaatataaggttcacatgggagaaggaagcagggaaaatctcagtcagcaacctgagtgggatttactgtaaaagcaagggaaaataataaatacttataaatttaccctcccacccccatcaatgttttagatagttaaaaattacatgtgccaaagatgaatagccattaataatttatccagaaataaaagcaaggcagctgggagacttctccctagattaaggaagagaggctgtgggtggttgtcagtacaatggactgagctgcccagttacagtttggttaagaggactgtgctggtatgaagggcaggttatttgcttgagtgcaccccagcaattgctcagcgcctggcagaaggttgtaac

SEQ ID NO: 388652 - DNA, 1002 bp, Homo sapiens
gggaaggccttcagaaacacgtgagggaaaatgatcaaaagagaaggaaacggcccaggcacggtcgtcacgcctgtaatctcagcactttgggaggccgaggcaggcagatcacttgaggtcaggagtttgagaccagcctggctaacatggtgaaaccttgtctctactaaaaatacaaaaattagctgggcatggtggcgggcgcctataatcccagctactcgagaggctgaggcaggagaatcgcttgaacctaggaggcgaaggttttagtgagccgagatcacgccactgcactccagcctgggtgacagagcaagactcggtctaaaaaaaaaaaaaaaatgaaaacaaagaaaatgaagaagataggggctctacatgaaccaaggatcctagctggttattttgattaaaagatgactcaaatgatgttaacactgatcagactttagcacgagagctgcagagaaggaagacactatgatgagaatatatttggggttttgagctgggaaaagacttcttaaatatgatccagaaagtactggccataaggaaaaaatgttaacagatttgtctgcaccaaaatctaccaagagagtcctttcaactagaactgccgtcaccacaatgatgaacatggggaaagaggagaggtacctgctgtatattctcaggccttttagaacacatggagttgttcctctggccacatccacacgaacctacaagaaaggagatgttatagacgtcaagagatgccccacggatgttaccaaggcaaaaggaatgccccacagatgttaccaaggcaaaagaggaagagactacatgtatctagtatgctgttggcatggttggaaacaaacaacagcatgattcttgccaagagaattcatgtgtgtgtatggagcataccaagcactccaagagctgggaaggccttcagaaacacgtgagggaaaatgatcaaaagagaaggaaacggccaggcac

SEQ ID NO: 388653 - DNA, 415 bp, Homo sapiens
ggctgcaagatgaacagattgaggacaaggttcaattaacagcacaaaattcctgagaaggccagggaaaatgggatctagaactttgcttccaagtatgatccatggactgcaatactgtcattacctgtcagacatgcagaatctcagactccactccagacctgctgaatcattattttgcattttaggaagatcccaggtacttggtatagacattagagcttgagatgcactgatggagagctgagctccattctactaagagggaaggaggcaaggatgatgcctatcatgattgatttgatatctgatggcaggaagctgaaggcatttttgtctgtaggtttctattacctctgtcaaagagcaagtggaattatctgctgacactggcagggaagaggtgaaggga

SEQ ID NO: 388654 - DNA, 718 bp, Homo sapiens
actgaaagaataaacactgactctaattttcagtagcatttctctataaacatgcttgttcaatacaaaattataatacatcagaaaaatgttgtaatgccttttgaactgatctataacataacacattaaaggacaaaaggagacatatcactgctttgatgtatagttaaaaagagatgccatcatcacaattattcaaatagtttacagtgtatgtttaaccaagtatagatatatttttaaatatgattatttctacctagtattttcagaattgagtttagaatgatttacttgggatgtgcggcgattcttttttagataagtgggggatgttaggaagacattgttcaagtgcttgaaactttaatttggacaatacattgaaccacatgctggaatgttttaagtgactaccttatagttttagtatgagcctacccttggaagaaagtaaggtgatactaaattagaaaaactatgtgaaactggagtggtggtatactttggaccatatcaaataggtagagtattataagcataaaagaataaaattgggctcgctttggaaattttaaacatatatgtgtatgtgtgtatatatatgcatatacatacacatatgtgtatatacacacacacaatggtttggaagtggaacaggaaatgataactctactgacatgtctataataaaatgatgtgctttgaaact

SEQ ID NO: 388655 - DNA, 553 bp, Homo sapiens
ctgtggcagcgacaggaggacaggagtgagcaggcacaaggagggaggaccgaggaggggagaggcaagaacagaggtggcaattgtgactcttgtgtggcagcggttctccacaccaacaggtggctctcaagtttgtgtgattccacatctgtctgcttcccccaggcctctcagatttcattacagctactgctgttttcaaagcatgctgtctcctggccacacagacccagagccttctcatttgtaagggtacataatagttatatgaattttttctggtacaagtatacagtgtgtaacaatcaaatccgggtagctgggatccccctcacctcaaacacggctcattcctttgtgctgggatattccaaatcttctcttctggctatttgaaacacaacaaattattaactacggtcaccctattgtgctactgaacatgatctctgacggatgcacctccagacctccaagcacctctcaaccagctaaacacactcggtgactggcaggcaggccctggcagaagccgatctctgctgagagt

SEQ ID NO: 388656 - DNA, 2530 bp, Homo sapiens
ccctcggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccccacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgtagtccta

SEQ ID NO: 388657 - DNA, 259 bp, Homo sapiens
gcggccgcctactactactactgctcgaattcaagcttctaacgatgtacggggatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgtagtccta

SEQ ID NO: 388658 - DNA, 2294 bp, Homo sapiens
ccctcggagctgctggccccgggcggctgctccagtctgagcgccctccgctcgccccgagagagacccggccatgcaggagccgctgctgggagccgagggcccggactacgacaccttccccgagaagccgcccccgtcgccaggggacagggcgcgggtcggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttgcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccccacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgtagtccta

SEQ ID NO: 388659 - DNA, 1293 bp, Homo sapiens
ggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgtagtccta

SEQ ID NO: 388660 - DNA, 697 bp, Homo sapiens
gcctcgtgcccagaaggctacggaaagggactaggcctgaggtcacccagcagggccgtgtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgtagtccta

SEQ ID NO: 388661 - DNA, 469 bp, Homo sapiens
aaggtcttcacactgggttcgagttctgcataatcactcccagattctgtccgggctcttcactgtgacagctcatgcttactgagtgctcaccttggaacacgggctataccgggtactttacatataattcccacaaaaatcctagcaggtaaatgttgtcatctccatttcacacttggtcaatggcggctcacataggtttaggctgtacagctagagaatgttagagccacaattcaaacccaggtctgtgacttctgcatcagctcaacctcaataccacaagccccagccaccctgggatgcctgcgacccttgactaaatcacgcatgcccacacgctctgtcctctgtgggaaaggctcttttgctggtcttgttcacctgcaaagctcttactcatcctgcaggctcagtgctggtatcacctcctcatcacaagctaaaagttgagtggagcaataac

SEQ ID NO: 388662 - DNA, 410 bp, Homo sapiens
tgcggtgctctagagaatcccctcgcgaacgtgttatcctcagccagagggagtggctgtggagttctccaaccctagttgtagccacagcacaagcctagggagtagactgctgtccttctccaaaaccataaaggccttacttctatttaagatcctaaccctaatctgcaggttaagatggctaaaaaatttaatacaaatttgagatttttgccttcaaagggtcagggaagaactctagtttagttccgaactaaagctgtagagaatcactaaccttttacccaaagataaaaatgtaggtaagaactggcattcttattgtgttttgcagccaacaaacattatccactatgattctcaaaaatcatagtggataacacgttcgcgagggggtcctctagagt

SEQ ID NO: 388663 - DNA, 708 bp, Homo sapiens
cccgggcaacaagttctcaaaaagattccagcagctaatgaagctctttaaaaagtcaaaatgcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatcgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgtaaaaaaaaaaa

SEQ ID NO: 388664 - DNA, 703 bp, Homo sapiens
tgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtggggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgag

SEQ ID NO: 388665 - DNA, 1058 bp, Homo sapiens
ccagtctgtcccccgcgtatggatatgtcatccacgcctcgggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggccttgggggatctgacagatctgcctgtcgtgcccaaggccacgtacgggctgaagcatgcgggagtccatcatgtccttccacatcgactggggcctcacatgctgggttgacgtcctcagatctttgggcaaggacggcgtggaccccgagagcggggcgcgtgggtacccctggccatgtatgggccccctgtgccactcaacgcagggtccccctaagcgcggggggcccccccctggaggaggaagcaggttggcccgcattggcgtgctc

SEQ ID NO: 388666 - DNA, 1071 bp, Homo sapiens
ctcccagcccctgaaagcccgagagccagagggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggccttgggggatctgacagatctgcctgtcgtgcccaaggccacgtacgggctgaagcatgcgggagtccatcatgtccttccacatcgactggggcctcacatgctgggttgacgtcctcagatctttgggcaaggacggcgtggaccccgagagcggggcgcgtgggtacccctggccatgtatgggccccctgtgccactcaacgcagggtccccctaagcgcggggggcccccccctggaggaggaagcaggttggcccgcattggcgtgctc

SEQ ID NO: 388667 - DNA, 569 bp, Homo sapiens
agttagagttctgatactcatactagctctgtgaccataggcaagtcagtctccactctctggccttcgtttctgtttataaaaagaaagggaaagaaccaatgatttctaagtcttctcctggatctacatttccaggattctttattgcagtgtcaacaaaggcacctactctggggcagagactgtattggggctttacacatactgcatctattttatcctcacatctcctcaggttagattttaatatttccaacagttctatgtttcctacaaggaaaatgcaaggtgttggtgggccggggcggggtgtaatctttctgaagttgtgtagatataaaagtcatcaatggatttaaacccaggcggcctgattctcacatctcccctggcctcaaaattatttccatattcatatgaaaaaccccagccagtcacaagagcccatacagtgtccagtgtctgtcactagcagaaggaatgaaagggaatttatctgcagaatgaggaattacaactggagtaaaaagagaatggtctgaaggtttctaggcagcagagtcaaa

SEQ ID NO: 388668 - DNA, 207 bp, Homo sapiens
tctgaagaatcactgcctgcctgatcttaaaataacatttttatcttagtcagaattgataatttataataggtccttgttgtctagtggctcaagcacttgtctcagcctggccttttgagcaatctgtagtctagatctggtgtcaccttgcctttccaaatttatcttccagtggctgctccccacaagctggttttcttcgtg

SEQ ID NO: 388669 - DNA, 412 bp, Homo sapiens
taggatccctctggctgttgtgctgagaacagaaggggtcaagggagtgggggagtaaaaatggaagcagggtgacgcatgcaggagtccagacaaaagacgggtgattttgctcaggttggtagcaacagaggtaatgagaagtagttggattttggatatattttgaaggaaggacctaaaagatttgctgatggcttagaagttaggtatgagttaagtcaaaaatgataccacagtttttggcctgaacaactggaaggacagaattaccattaactgatatggggaagaccgtggaaagaacagttttcgggcattaggaaaaataataacacatttgtatgcttttgagaatggttcagtggagagtagaaatactgacgagggagagaattattggagtcatagc

SEQ ID NO: 388670 - DNA, 307 bp, Homo sapiens
gcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttcttttcgcaggggtcagcacatccggagtgcaatggataagcctcgccctgggaaaaccaccttcgtgatcatggtatctcccctgcgatttccccaaatgtgggaaactcgactgcataatttgtggtagtaggggaaagcgtcgacg

SEQ ID NO: 388671 - DNA, 178 bp, Homo sapiens
ccatcttgacctcccaaagtgctgggattacagacatgagccactgtgcccagccagggctgtgtgttatgtagtgacagctcactgatacagctctctctggggacttaggaaccaagtttgaccccacatctgactcatccaagttttatccatcccacctcccatatctctccag

SEQ ID NO: 388672 - DNA, 455 bp, Homo sapiens
tgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagcccgatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttcc

SEQ ID NO: 388673 - DNA, 393 bp, Homo sapiens
gaagtctgacaagggtaaaaccaggcagagcgagcaccaagcacaagaaagctgtaaagacccacaaggcaaacatttagaaaacccactcgcccgtggcttcctttatcccagagtgtcattagtgtctgtggtcagctacttgtactacctctgaattagctaccatttactaagtgcttagtacatgccaggcactgtgctaaacatttcatatgcattgcctcatttactctataaaataacagtgagttgaatattatttctgtcattttacagatgaagaaactggggtacagaaagatgagtaacttgctaaaagtcacaaagatagttaagtgttagatcaggatttatgctgggattttaggcagtgtgcaaaaagtttttttt

SEQ ID NO: 388674 - DNA, 253 bp, Homo sapiens
acaaaacacaacgaatggtcggatgtggctgtccttggtcatgatctctttcattcttgaatacctactcatcacttacagttctgcctcagtttactgtgcagaagccacctgtcatgtaacatccaaatctggtcatttaggacttaacttccctccatctcttcatactgagatgtagtgatgggagatttccatttcttctttcaaatgttgtttatacacacatttcaggcataaactttgtgggaaa

SEQ ID NO: 388675 - DNA, 396 bp, Homo sapiens
cagaaatcccgatcgttacaagccataggcatccatattaatagcacgaatgctataattagtcatttagggaaaaataaaataaatctgctccaagacagtctccctgaattttgtaagagttagaaggatggttttaagattgctgatcctgccatgctgacttgctttcccaagaatgcctttgaccttagccagcactagtaaagaactcagcaatgcctgtgaggagggccaattccatgtccccagaggacaatgaggtcccctcaacaatactcactaacatatgtgagcatcccacaacactgcaaaggctgaatgactcccacctgagatctgtcccttctaaactacctctgaccgctcagaggccctgcaggccaaactacctct

SEQ ID NO: 388676 - DNA, 425 bp, Homo sapiens
aaattagctgggcgtggtggcgcatgcctgtggtcccggctactcaggaggctgaggcaggagaatagcttgaacctgggaggtggagcttgcagtgagccaccgagattgtgtcattgcactccagcctgggcaacaagagcaaatctccatctcaaagaaaagacaagacaagacacctttgaggtcctcttctggtcctctgcaccagaaagcttgggagagtggggacatatttttcccccattgctgcattcctagtaactagatgtgtgctgcaaaaaaaaaaaaaatagtttaaggaatgaattggtagctattgttatatgtaaatgtgaaattaatatctacaaatacatatctgtatttataaattgtacttacgtagagaaacaaaaaaataaaaataattgtaattacatact

SEQ ID NO: 388677 - DNA, 373 bp, Homo sapiens
ccacgcccggccttaaatttttatttatattttgagggggtctcattgtgttgcccagactggagtgcaatggcacgatcatggctcactcaaatctccatctcaaagaaaagacaagacaagacacctttgaggtcctcttctggtcctctgcaccagaaagcttgggagagtggggacatatttttcccccattgctgcattcctagtaactagatgtgtgctgcaaaaaaaaaaaaaatagtttaaggaatgaattggtagctattgttatatgtaaatgtgaaattaatatctacaaatacatatctgtatttataaattgtacttacgtagagaaacaaaaaaataaaaataattgtaattacatact

SEQ ID NO: 388678 - DNA, 453 bp, Homo sapiens
ccacgcccggccttaaatttttatttatattttgagggggtctcattgtgttgcccagactggagtgcaatggcacgatcatggctcactgcaatctccacctcctaagcttgattctcctgcctctgcctcctgagtagctggaaccacaggtctgcaccaccataccaggctaattttttgtatttttggtagagaaggggtttcaccatagtgctcaggctggtctctaacttgtgagctcaagtgatccgcccacctcggcctcccaaagtgctgagattacaggtgtgacccatggcacctagccgagtttaactcttaaataaataaactgtgccaggcatggtggcttgcacctgtaatcccagcaattcaggacatggaggtgggagaattgcttgaacctaggagtttgagaccagcatggacaacatagtgagaccttgtctc

SEQ ID NO: 388679 - DNA, 837 bp, Homo sapiens
gagagaaggacggagtcgagtggcaccctagaagacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggcc

SEQ ID NO: 388680 - DNA, 1581 bp, Homo sapiens
ggctgccggggccgccactgcagctgctgctgcctgctggttgccgcgtcttcccggaggcgactgctggaagctgcagggaatttttgcggtgctctgccatattgtgtcttccccggccggtccctcgcctcccggccgagctgacgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaaca

SEQ ID NO: 388681 - DNA, 638 bp, Homo sapiens
gaggtctgaggggctgtcccagacaaggcggagataaaatgagcctcagggagctggcatcccagaccagggggctgtgcacacttgccctgtcaagctgccgagtttctggctgagtgaagctattgtctcccctccccaggcccacctgcccttctctggatagattcctgtgctaagaccagcagagtaggggtctccatggaagaggaagagacagtgtccaaggggtgccaggcttccatagtgatgggggcgggccaaggtgcagtggtcttagctggactccatcattggaggacactttgcccacagcccaggagctacaggtcctgagtcagggactggcactgggaaagggagcagaggcttatggcatccattgaaaattctgaagccatgctcccatgaaaggctggggagtccatttgcctcccatgggctcccccacctcccgctccaccccagcccatgtgtgaggagcggaggtagctttgctcagagtgcaaacccgtgaccccttctgctccagccccactccccgctgggcagccagccctctgtgcccctctccaagctccacccaggtcccagctctcctggcaaggcaaagggaaggaagggaggactccccctgt

SEQ ID NO: 388682 - DNA, 416 bp, Homo sapiens
atcctagattcccttatcctttttcttggatcagatctcctgtttcctgagttcacatattcctcattttgtggtttaccccctcagtttgatggtgtacttcctttagtattttcctgagagaatgtatgaagaagtgagaattttttagatttgtaacccttaaatgccttcaatcttgtctctcatttttgacattatgggcatgtaattcaagaatagaaattctaggccgggcgcagtggctcacacctgtaatctaagcactttaagaggccgaggcgggtggatcacttgaggtcaggagttcgagactagcctgaccaacatggtggaatcccgtctctactagaaatacaaaaattagctaggcgtggtagcaggcgcctgtaatctcagctacttgggaggctgag

SEQ ID NO: 388683 - DNA, 531 bp, Homo sapiens
gcgtccctactactactaaattcgcggccgctcgaccaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagtgctagtgt

SEQ ID NO: 388684 - DNA, 339 bp, Homo sapiens
gcgtccctactactactaaattcgcggccgctcgacctgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttttttaaccatttacaaattgtattttcaaaaattgaagaaagtcgacgcggccgcgaat

SEQ ID NO: 388685 - DNA, 1111 bp, Homo sapiens
ggagtgacaacaacggctaggtgcgaggctgggtggcgggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaactta

SEQ ID NO: 388686 - DNA, 868 bp, Homo sapiens
ggagtgacaacaacggctaggtgcgaggctgggtggcgggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatcccta

SEQ ID NO: 388687 - DNA, 1249 bp, Homo sapiens
ggagtgacaacaacggctaggtgcgaggctgggtggcgggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagtgctagtgt

SEQ ID NO: 388688 - DNA, 393 bp, Homo sapiens
cactctgattctgggaccagtacttctggattccagtttttcctctcattccccaagagacagagtaaccagttgtaataattaatgatgctggaagtaccagcttgcaagactctttcagtaacctctggaagccacctgtttatacctctctgattattactatattgttaaaagcctggatggacacggagtcagtgaatgagttttcagtgtccaagtgtagatctgggacttgaagacagaatttacaaattatggtatctgtggcaagatagcggttgggatagacttgggagaagaaattctttaaaggaaaaattgaatttgttgcaaaagaagtttgtcactgaaacacgttttaattgctcatcgtaaatcagagtgtaaaag

SEQ ID NO: 388689 - DNA, 951 bp, Homo sapiens
caaacaactataattacaccctactactgaagtctagcagaaagcctctctctcactgtctcttactttctcgctcgctctctctctctatatataaatacatatgcctatatatgtacattttttaaatgaagaatgagttctcttaatcagttcccttaattcagggaagtcatgaaaaacaaatatagaaaagttactataattttagatcagtattttttatttatccagcatacaataaagctattatcccataacataattcgttaatgacttgaatattttactgggaaagaatgttacctggagaactacttggtacaaaaatatttgccttctgtttttttatttgttcttgatcatcttcatagtcagcagcttttactttgagtatatctgtcaaaatgaattctttcataaactcttcctcttcactctcagcaacattttgtaaattaacaccaagtgaaaagcatttgggataactacggtttactggtctctgttgaataccaaaaaggaaaataagtttacatgcttgtctccaatgattaatatgcaaataaatgaaatgtactggaaccttactgtgaactgtgcgtctgatcctgccacccacagaacaagttccagttgaacttgtgttacaatgaaatttcactgaatttagaactcatttaaggtttagtattacacaatatgatttttctatagcccatctttgcaattcttcactgaaagactgctgaaatagcccttcctcccctatggaaaatgttctgagatactcaactgtaatatttcaactactgagaatacacagtgtagggcagggtccaaagataccagaccatgtgaccctaaatcctttttttccccatcattcagaaaacagtaccacctaaagtgctgtagagtaggcatgcttttttctacaaggtattcatg

SEQ ID NO: 388690 - DNA, 304 bp, Homo sapiens
cttgttcatggcactttgcactgtctctgtcttaactcccaggtaggctctgaaattgatgacagggatggaagctcattcgttcagtccacagcatgctgagtgctttatgctcttggcctgtgatcctcactagcaccctttaatgtggtgaccatcccattttacagacgaggaaagtgaggctcagagaagtttaaccatttgcccaagcctggccaatcccaggcctgggctctttcaacagcacagtgctgcctctgcaggggctccaccctgggctgggtttttgggaactcaggac

SEQ ID NO: 388691 - DNA, 237 bp, Homo sapiens
gtgatctgggggctggaagcacaaagatatttccaagatcctgggtcagttcaagcagggactaggggcagatgataagcccactcacagtgccaagaagcagggtttaggggagactgggaattggaaaaggcttttcagaaggggtcaatcagaaagcggcaggagagattcccgaggcacccacagcacacacaaaggccctgaggcaggaacagaggggccacaggccacagc

SEQ ID NO: 388692 - DNA, 554 bp, Homo sapiens
agtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacaggtgggagctctgggcccagggccggccgtgcgctgtcacccgggtcggacttcgcgggcgaggggccgaagctgggcacgcgggtccctggctgcgggcgcggcatttccctcccgccgcccgggacagagacctcgggctgctgagcgactgcgccccaaaacctccggcctccgtgggccgcttcgggcgggttatggggtggcggtgggggaagggactggaaagttaggtcgagctcgaagttcagagatgaaaggaaaccaccgggctttgtttcagaggcccgagtcctcccagtg

SEQ ID NO: 388693 - DNA, 360 bp, Homo sapiens
tgagcgtcccatttgtgtggggtgagcacagaggtcaggagggcagtgcaggaacaacttccctcttaggccaagaaatctgaaactgggaaggcagtggggagccttagtgtgttttttagctgaagtagagtcacgctttagggagattggatttgactggaatatctaagataggttggagctgggagagaccctgggatgccattgttgactaatattctgttcttgtccatggtgtcttgtgtttctgagggtgcactagatgtgggtaagacagttaaggagcagaggggatactgttttgcctcaggaagggcttgcccctctcctgtcagcagctgggttgatgtgctggtc

SEQ ID NO: 388694 - DNA, 401 bp, Homo sapiens
gcagctgctgccaatgccagcttccaatgccagcttcctccatttgaacaaaactacggagctctttgcacttttaattttttcctcttccctgctagggtagctggcaggagttaataaacaataaaatacaactggaggggtgacaggcaggaactaccggggcctgtggcagaccagatctatggcatggtctgccaccctgtctgtgtgccaggggcaagataagcctaactttccccaagctcgatttcctcatctcatctgaaaatgatgaataaaaatatccacctcagagctattaagaaaactgaacctaaggtaagcaaagtcctgctcctagcacttaaatgtaagctactcttactctagttacacataaagttacttccaaaaacctt

SEQ ID NO: 388695 - DNA, 432 bp, Homo sapiens
cgattttagttcggaaactaagggaagttgtgtagcaggtagctatgtttaaaaaaatgtaatttagacactcccatgcttaaaaatcctttggttttccattgcagttggaatgaaatccagactcattgtgcccacaaggttttccatgtctgaccgttaactactacctttccacgatctcctactgctcacccacttcccttagtacactcacaatatgctggtcttctttcagcttctctatgttccagactcttcccacttcaggccttttcctaactgttctttctcttcctttggtttggggcagggcttgcttaagatcccttcttcaggaggcattgctgattactgtgtcctctttctcccataatctctatatttagacttttttcttctttattcatttgatagagtttataattgttt

SEQ ID NO: 388696 - DNA, 634 bp, Homo sapiens
agtaatgatacgatcgagcgctgtaccgatgagtaatcttggcatgcatatgcttatgttcacaaattggcacttagaaaataattctccatatctcatcacaacaaagaactttggaaaatacatcagtcctccatgggaattctccaaagactttaaaatattaatttctacaacatccttatttcccaaagtagcatacttcctttcccacgtcaggagtacttcccactaatcactgttgtcttattgccttgctcagacacatggaaaatgatttgttgactgctttctacctaagttaaatcaaaactttaactatatcttttccactaacagtatttctcattactattgcaaagtattaatggataactatatctccaataaatgcagcctcctagctaatttcatttctttttagtttcctcttcgatgttgagttacttcttagttttataagtggattttgtcagtgcatctcttctcatcattcattctattatgatattacctattttttaggggcagtttggaaagcatgtatctcaatccttgattaatatatatattaatgtcatgtattcatttccttgtatttctgaaccctactcccacattagaatcacctggg

SEQ ID NO: 388697 - DNA, 311 bp, Homo sapiens
caacaactgaaaccacaacccacagtgaaccttattaacggaaatattttatatattgttattttcatattttcacttatcatttggtaggaataagagcctattgctcatttttattccatggatgtctacagaaaacccaaatcatacgtcaagtgatgattatttccttcatttttgtgaaggatatctaaaatttatataaggccagatatatctctctttgaacatgatggttttaaacaagtcaactttaaaacatgtaataagcagaaaatttgccatcttgattttttagatgaggaaatcta

SEQ ID NO: 388698 - DNA, 445 bp, Homo sapiens
ggtggcaggcacctgtagtcctggctactcaggaggctgaggcaggagaaccgcttgaacccgggaggcggaggttgcagtgagctaagattgtgccactgcactccagcctgggcaacagagaaagactccatttcaaaaaataaaaaataaataatctattgattgagaaaatggagactatgagaaatgataaatgctgtgatgagatgcttttaaatgaactcataacaacatctgtgggaatgtgaaaagtgaggcatctagaatgtagttctttattcagtctgtgcacaatgcttgactccaaatggaatcctggacccctggatcactgtgtggttcttaaataatccactgctgaggggcaattaaaagggaagtagagaagaaataactcacctgtgctctcccaggaacactggtagaatcctagtccattctc

SEQ ID NO: 388699 - DNA, 239 bp, Homo sapiens
tagaggatccgtaggttaagggctacctgtttcagactatttcttctggaatattgcatgaactgtcaatctcaagctttctgggagactgtaaaaactcaaggtatagagagggtaaaggaaaggggccttaaataaggaaagagaaatggtcacataggtttcagagtctgaaaaccaaaacagaagccctaaggtaacagagagaatagcttcagaaatgggtagcccttaaactg

SEQ ID NO: 388700 - DNA, 458 bp, Homo sapiens
gccacagtgccatattaatttttaagcaaggcctctcctgtatatcaacagatgtatataactacttctcctttcctataccattattcatattctaaatttgttttgtttatttgcttctataaacagcatcttcatactatagttttattcttattttagaaacatttcctaataggatttttagaacaaagtgtattaatatttttatgacttttgataatactgccaaagagctttccaaaaggactgttagaatttacaatgccctcaccaatctctgcaggattatcattaaacctgaaaggacagccaacactcaccatctctaatttcttgcctcacattcatttctacttttaaaaattcattacaatctggtttctttttcaagcaaactccagaagctacatttactaatattacacatgaccttccaaatggccaaatttgactat

SEQ ID NO: 388701 - DNA, 424 bp, Homo sapiens
ccccccggagcagatggaaacacgtttgtatgctgagagagtctgcagatttaagatgacagttgctcttagcctgcacctgagtatattccagctctgcaattcggagttgggcacttgaaaagctaggcctgcccttgctgaggaagggcaagacaatgaaagccatatccaacattgcttaacagccactgtataccgagccctgtgctaaactcccagcagcaactcttaaggtccttgttctactgatgagaaaattgggtctcagaggatcccagaggaggaaaactggggcttagagaatcccagaggatctcagaggagtcctggagtccagtgtacttcctaactcactgtgtgacctcaggcaagtcgcttgccctctctgagcctccatctcctcatttccacccatctgttg

SEQ ID NO: 388702 - DNA, 413 bp, Homo sapiens
cattttcaaacaatgacaaatttccagttttcttttaggtgtaagaacttccctctctaagatataatgtaaataaaacactaattagaacttaaatgtaactttgagaaaaaaaaagttaggtatcatatagtaagactaatttccctaaaatataattctagttatgactacaattagtgttagaattttacaagaaaatgttttactgagtcaagatctaacctgcattcatgtaattaaatttcccaagtggttgtgagaggatgtttttactgaggcaggtggttacttactgctctctgatcccatcttctcaattgctaggacatggggcaggatatgaggtactttctctacaaatgacttggggaaatatttgcttaaatagtcactgacatgtgaacattgtg

SEQ ID NO: 388703 - DNA, 361 bp, Homo sapiens
aaaatatcaccttttcttccctagaaggtgatcaaaatttgccccaattttggttatttgtggagtcttcattgttaagctgttttcctccaccttgattatcatttctaaactctgttaagatctcattgaacattattaatttggaattcacaataattcatatgtgggagtccaggtaagagctgtgttgccaactttcaatgtgcagtcatttttgcaagagaattgctggcagtcctagagaaatttgtaagtgcttagaagaatacatgtcatttaattcagactaatttgcaattggcacattagttatttatgacacagaaattcatggagattaagatttgattagcttgtt

SEQ ID NO: 388704 - DNA, 834 bp, Homo sapiens
agagacagggtttgccatgctagccaggctggtctcgaactcctgacctcaagtgatcctcctgcctcagcctcccaaagtgctaagattacaagcatgagccaccatgccctgcccctattttctaataaggtcacattctgggattcctggtgaatgtgaatttttggaagacagtattcagtctagcaaaaggcagaacatcctcattttcttccctacctcagaaataaagaagttaacttcaacccctctgagagagagaggcttcctgagcttccaacaatcaattatccaaatattagtcacagaaggacactaagggttgtgcacagcacgtggccagcccattctctgagtctgtcaagtttaaggtgaacgctaatcctgaatgagtcttaaaatgtacttggcatatcctgttcattgtaaaatgttctcacattgtgatggctggggcttccctctcaggtgtaatctgcgaagtcagacgtgacacagcctgggtgaggtgggccaagccgggaactgggttaggagggaagctggggaatgatctccaaggtctcagatcccaaactggctttagccagattcacccagagggatctcataaaaaatgcacattccggggcccaccccagacctaatgaatcagaattacctgggaaggagcctggggagctctgttttcagaagcagcccagccgaatcctacggtcagacagggctaggaatcgaaactcagtctagcgcggtagttcccaaactcgtctgtgcttcaaaaaatacagatgctgatgtccagacatggtggctcatgcctataatccc

SEQ ID NO: 388705 - DNA, 399 bp, Homo sapiens
ttttttaaagcgaatcatggtgtaatggaaaacgcacagtacttgtcatcagaacactgccactcttgccacttgctgggtgtgccacttaactgcctcatgggcctcagtttcctcagcagttgaatgagtgggttgaagtagatgctctccaaggccccttcccgcattaggaactcggatttggtccagaagctgttctgccaactctgctaactgaagaaacatctgtgttcccaattcagttcccttaaaatacagctcctgcacagacttaagtcccctttgaaatggatttgtccatgcagattttgcagaccagagacttcttaggctggagttatacctctctggtattcatgactctttctgtagcactgctcttactgtgcagtgtcc

SEQ ID NO: 388706 - DNA, 259 bp, Homo sapiens
ttgttctttttctggttgtggtggttgcagaaatctatacatgcgttaaataggaccatacaacaacaacaaaaataagtttcagtatatgttaatttttaaattaaatcagaagactgagggttttgagatcagatgaccagggtttgatcccagctctccagcccgctaagactgtgatattggtaaagtcacttgacctccatgaacctcagtttctcctagacatttagattgctcaggattgaatgtagaaccc

SEQ ID NO: 388707 - DNA, 385 bp, Homo sapiens
ctagagaaaaccccgctacctggcatttagtaaatggtgactatagtagttattggggatgttattatgattaccatatttctcattatgcaaataattctctttgaggactaagcttgtcttatatttagtttatgtcctctacaacactgtaatactaccagccacgtgctaagacatgaatgaatacatgaataaaatattttcagaaattcttcataaatctacgttagcaggtgagtaactgcaaggtgaatatctcattttattgtaagtgatttttcaataccggtcatcattaggatcaggtccccctggggcctctcactactgaccatggcccctctagctagtggcacttttaagagtcttttgctttatgata

SEQ ID NO: 388708 - DNA, 450 bp, Homo sapiens
  misc_feature (92)..(92): n is a, c, g, or t
catcgagcatgccgagttctcggggaacctgtatggcacgagcaaggtgccggtgcaggctgtgcaggccatgaaccgcatctgtgtgctgnacgtggacctgcagggtgtgttctgaaaagtgttcgtgaagggctgggtttgtatgactgaagaatcgtgctgtaccactgggtccggagctgctatgccttagctggtttggcaccagccacctcctcatgaaccccaactggaaactccacttccatgaccgaacaaaaaggaccagatttccaaagggacacagctagaggaaatggagccaatactaactttatatggccaatgcattcatcactggttcaaaccggtacccagtcagtgaatccgccagcctgattttgcccatgtatgaccctactcccagcgcaatcacataaatgcccccaaacgttgagttggagtatt

SEQ ID NO: 388709 - DNA, 190 bp, Homo sapiens
cctgggctccagagatcaacccacctcagcctcgcaaagtgctgggattacagatgtgagcatggcacccagcctcattattcattttttacatctcttttttaaaaatgatttttctcacaacacatgcaatttctcttattccatcccaattcaattcttttttttttttcttttctttttttttttt

SEQ ID NO: 388710 - DNA, 238 bp, Homo sapiens
cagtgatacagtaagcattattgatattatatgaaactctctaaaatccatctttcattcattatattttaaaacatctttgaacttggaagctacgttccactcaagccagtgattcatgccattctggattgtgtgtattgcatgggaatattacaataatatatttattttaaaatatttatattcttgggatattgtaactggaagtgtgtgtcaaacagaaactggctagcag

SEQ ID NO: 388711 - DNA, 309 bp, Homo sapiens
tgggtctcatttttctcatctctaaagtgggggttgggctaaaaatcctccaaggcccctttcagcttgtgataagacttcaagtcgccttttcaccctgaaggagtccatttcagtctgcaccaacagtttattttctgagtcacagcttatttctccatgcttatcctaaaaatgttgtgcccaaatagttctaagctctcgagatttattcccactcagaaagaaatggtctttcaagacccactaacaaaatgtttcaaaaggatttaaaaaggtaaaattagtttacttaagtataaaggcaaa

SEQ ID NO: 388712 - DNA, 299 bp, Homo sapiens
gcggcgccggacccggctgcgcgcggaccgttagctactgcggccgggacgcggccccgcccaggcgagcggcgggtggctcttaccagcgggaacgccatggggccggtgtggccctgcggggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggcc

SEQ ID NO: 388713 - DNA, 426 bp, Homo sapiens
gatcacttgaggtcaggagtttgaccagcctgaccaacatggggaaaccccttctttactaaaaatacaaaaattagccaggcacggtggcacttgcctgtaatcccagctactagggaggctgaggcagaggtttcagtgaaccgagattgcaccactgcactccagcctgggcaacagaacaagactccatttcaaaaaaaaaaaaaaaaaaattcatgaagtctgtgatcgttatacaaatgcatgacaaacaattgtagaaaatcaattgactctacgtgtataggtctatttctgttctcttattctgtccattggtctttatgtctattctggtttttttgtttgttttgttttgttttgagtcagggtctcgctctgctgcccaggctggaagtggtgcaatctcagctcactgcaacc

SEQ ID NO: 388714 - DNA, 340 bp, Homo sapiens
tgtgtggcagatatttaaataggaaactatgtagggcctagttgattgcctatatagaatccagtaccctgtctatgccccttcactgcccaagcatgtcacaaggaactgccctattccaagctccagaggacctgctgagtaggtgcttttcaggagcttgaaaagactgtttccaggtctacccccaggggttaatttaattggtctggggagaggcctaagtatcagtttttttgttttgttttagttttttagtaaggagagactttattgaaaaggatttttgcaaggaggggaaaacgactgttgaaatagggaggacactctgaccataagg

SEQ ID NO: 388715 - DNA, 314 bp, Homo sapiens
taggctacgcagttcatctgtgagtttttccaaactatcacaaatctccaaagtattttccaatatatttattgaaaaaaatccatgtataagtggatccacacagttcaaatccgtgatgttcaagggtcaactgtattttgctataccagtaatgaacaatcagaaattaaaagttaaaaatcaacagcattggccgggtgctgtgacttacgcctgtaataccaggactttggaagaccgaggcaggtggatcacttgaggccaggagttcaagaccagcctggacaacatggtgaaacctcgtctctacc

SEQ ID NO: 388716 - DNA, 744 bp, Homo sapiens
tgggaaggccagtctcccaacgacggcggcttggatgcttatggctgaggccaaggtcccactgcctggacggaagttccggctgagaccaacgtcccatggcctggagggaagttccggtgggtgggtgaggggttgctctagcagctgcttctttaaccgtgggtggtcgcggagcctgcaaggcgggggaggagcatctgggggcgtcaggtccagtttcacactctagctcctgccctaggcccctaggcacctccacatcacaggctgctcagctgcttcactggctgagcctggagacttcaacacaggaattaggggttcacactgtcagcaggatcattggatataaaatttcactgcaggcctttctgaagccaaacataagtgttccccagccaagaattagccatttgatgcaaaatgtaggtgggcgtggtggcgcacacctgtagtcccagctactcaggaggctgaggcaggagaatcgcttgaacctgggaggaagaggctgcagtgaactgagattgcgccactgcactccagcctgggcaacagagcgagactctgcctcaaaaaataaataaataattttttttaagaaaatagccatttgatactctgcctttttcccccctaagaagggattttgagttaattcatacaaataagacaagataacaattgtttaaagtgaagagctagagatcaagagacataggaaaaataagataaagacag

SEQ ID NO: 388717 - DNA, 405 bp, Homo sapiens
gtagtgtatgtgggagacatttattaggagtaaaaaacattgatgatgaagcaatttatacttctgggtaggcataattattgcttaaattgtaacattaatcatagtcgtattttcatataaattgagattttttgttaaagtttcatgggcccttggctttacatttttgaaagtaaataatacatttattggatttttaaattcagattaaattgcattttgtaaaataaggtcacctgtttcaaaacaaaatcaacccttccataaccagaattataactagtaccttagctactccagtaatattgtttttctctaaaagttttttcttaaattcatttaaacccaaaatttttttcttcctaacttcttagcgacatatatccttatagttctagatgt

SEQ ID NO: 388718 - DNA, 4499 bp, Homo sapiens
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattcttctttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatgtaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgcttta

SEQ ID NO: 388719 - DNA, 4605 bp, Homo sapiens
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattcttctttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatgtaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtcactg

SEQ ID NO: 388720 - DNA, 3648 bp, Homo sapiens
agggtatgaccagttgggaaaaggggcatatgtgtgtgtttgtgtgtgtatgtgagagagagagagagagagggaaatatggaacatagctgagttgaagaaatagaaatttttatttctagtccctttctgaaagaattgaatgtttatatactagaagcaagttattttgtcctaaaaagtctgatcttattgactgatgttgttttgttctttttcagtaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattcttctttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatgtaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtcactg

SEQ ID NO: 388721 - DNA, 3669 bp, Homo sapiens
  misc_feature (3431)..(3434): n is a, c, g, or t
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaaaaaaaaaaaaaaaaaaaaaaaaaaaaaaaaaaaaaaaaaaaaaaaaaaaaaaaaaaaaaaaaaaaaaaaaaaaaaaaaaaannnnaaaaagggaaaaaaaaaacataaaaaaaaaaaaaaaaaattgtgggccgctttggcccaaggcgtttttaatttgggccagttttttctttgggcccgattttgggccaatttggccaatttccccttatggggggcgtttaaaattaaatggccggggttttaaacggttcggattgggaaaaccctggggtttccccaattatacgctttgaaccccttttttcctttggctg

SEQ ID NO: 388722 - DNA, 4659 bp, Homo sapiens
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattcttctttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatgtaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtcactg

SEQ ID NO: 388723 - DNA, 3901 bp, Homo sapiens
  misc_feature (3431)..(3434): n is a, c, g, or t
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaaaaaaaaaaaaaaaaaaaaaaaaaaaaaaaaaaaaaaaaaaaaaaaaaaaaaaaaaaaaaaaaaaaaaaaaaaaaaaaaaaannnnaaaaagggaaaaaaaaaaactccaaacaaaaagtgctgttagcccaatgttatttttatacagataatataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtcactg

SEQ ID NO: 388724 - DNA, 1581 bp, Homo sapiens
agcggggagggccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaatgtaagtatttagttgagatatttctgttgtatcctaggaacaaatcataccttgtgatactgttgtgttaagagggtacttcgatttaaagaagttcacacagaataattagttcaattttcaaccagataattcccaggtcttcatttaatagcaatttacagtaatcacaatttcacctttaaattagaaagtaaatttaagagtgaaggcaaagtcctactttctttccaaaactgcaattactgtcagtaattttcaagattcattctcttgatttatacaaaatagagaagtaaagaaacagtaaaaggggagagattagctaatccttgttcttttgtgtgtt

SEQ ID NO: 388725 - DNA, 214 bp, Homo sapiens
aggcaggaatcatggggggctcctggaggctggaggacaccctcactgaatcacacccaggaatccatttctttctttttttcttttcttttctttcttccttccttccttccttccttccttccttccttccttccttccttttttttttgggagtctctctctgcacttcagcctgggcacattgcaagaccttttctctaaaaaaaaaaaa

SEQ ID NO: 388726 - DNA, 1110 bp, Homo sapiens
tgtgagacttgaatggggaatctgacagaactcagtgttctgaggagtcttgtcaggctgctggaaatttttgatattctaggttagtttacctcaacacatcctatcacaaacagaaggggttggcttatatatgtgaagaagataagagacatgtagataggtgtgcgtagtaagaaacattgcaatggagaaagcatcttaattcttacttatttttcacaggtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaaataactggaaatttaggattgttattgtactacacaggtcacaaagttccaaacctatttcccttgtaatttttagtgcatgatttttcagaatgcagtttctatctttttaggtgcaatattaagaactgattaggtcagaacaatttagtttctccagttttttctacctaagttacatgggggaaaaaaaagcaatagtaactttaaggaagtatgaaaataaagtcttggagcag

SEQ ID NO: 388727 - DNA, 1289 bp, Homo sapiens
gttgtctgcggtattcaaaaacttttgaaacactgcatgtccaacaaaatttattttttgtgtgaatgtaagtttttattgagggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaaataactggaaatttaggattgttattgtactacacaggtcacaaagttccgttgaagcctcgggatcctctagtca

SEQ ID NO: 388728 - DNA, 1452 bp, Homo sapiens
gttgtctgcggtattcaaaaacttttgaaacactgcatgtccaacaaaatttattttttgtgtgaatgtaagtttttattgagggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaaataactggaaatttaggattgttattgtactacacaggtcacaaagttccaaacctatttcccttgtaatttttagtgcatgatttttcagaatgcagtttctatctttttaggtgcaatattaagaactgattaggtcagaacaatttagtttctccagttttttctacctaagttacatgggggaaaaaaaagcaatagtaactttaaggaagtatgaaaataaagtcttggagcag

SEQ ID NO: 388729 - DNA, 1254 bp, Homo sapiens
gttgtctgcggtattcaaaaacttttgaaacactgcatgtccaacaaaatttattttttgtgtgaatgtaagtttttattgagggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggaagtgaactgatgctggcttctctttgtcttattccaagttgggcatgagattttccctgcattagaaggttgttgagacctgaagcctgggaaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggattttcattaagccaactcatacccagtttctacaaatgaaaaccaagtcaatcatctaaaatttcatgatttcttcccatcaagaggatctggagtcttctgttcccattaaaactgaatttatggcagtgcaaacctgggccagactgggtataaaatgacaaaagcatatttatattcttaaaaatttctgcagattgcatagaaagttctcagatttgtggctgggcgcagtggctcatgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccaagattgtgccattgcaatccggcctgggctaaagagcgggactccgtctcaaaaaaaaagaaagttctcagatttgtaaaagtttatttctattgtaattctttgcatgttcactttgttaaatttgcaatataaaccagttgcacgtc

SEQ ID NO: 388730 - DNA, 119 bp, Homo sapiens
gatccacatccctgatgctgaaccagagagccccacatccctcctcccagtacttaggcagcgccttctgtgtgcactgcctcttgccgggcactgggtaggtgcacacgaggaccggg

SEQ ID NO: 388731 - DNA, 1073 bp, Homo sapiens
agtagagacagggtttcacctgttgttcaggctggtctcaaactcctgggctcaaatgatctgtctgtcttggcctcccaaaatgttgggattacaggcatgagccactttttatcatgttctatgaggtgataaaaaataaagtagataaggacatcctaaaacaacatcatactagaaaacagatttattggttatcaaactccattttaaagactttttaaacctaagagctacaactctgaaatatttttgagaataaattatttttaaaagctatatattttttatatacttgcaaggctgacatgggttaattgcaaagcagaaaacagtaattgcctgtaaacagtttgatcactattgttatatcccatgaaaacctaggattgccattaattctctgttcattaccatgtcacttgcaatggcaaagtatttgtataatgcatattttttggtacctctttcctctgtgaaattttgacactattttactttagcaacagatctcttacctgtttattaaagaagtacacttgcacctgttttctgccccacaggtattctcaatgggtgaggtaaatactcatggtgaagtgcttatcccaaaggctaaaaacagaattgtggaataagaatacatgcattctttttgagatttctgtaacagaaatctggtgaaatattagtggagaagtgtaaaaattaatcatctcagtatcactgcacagtaatggatgttaagagtactgaactggtaatcaaaagaactgagtttgaatgtataacctcttatttgctgaacagtgatattcgcttaacatctttgggcttcgctttcctcataaacagataataacttctatcttcctcagaggattgttaggagaatgaaaataacattgccatatatgaaaaaaccttcataatcctcacaaatatgcaaatattagtttgtcactagaggaaggtcttttttctttttgtaatatattaatattcacagtaaactataacagagtttatttaggcatttttggaaattgccacataaaccacatgaagttttt

SEQ ID NO: 388732 - DNA, 721 bp, Homo sapiens
aaaagaaaaaaataataatttttgataaagttataacacatctgtaacctcgaactacaatatttgagtaagagctgccaacagggaagttcaaacaggagtgcagggaaatacctatagacatctgtggctgagaatctcagctaactgggaggccaaggtgggcagatcacgagtcaggagatcgagaccatcctggctaacaacggtgaaatcctgtctctactaaaactacaaaaaaattagctgggcatggtggtgggtgcctgtagtcccagctacctgggaggctgaggcaggagaatggcgtggacccggcaggcggagcttgcagagagccgagatcccgccactgcactccagcctgggtgacagggcgagactccgtctcgaaaaaaaaaaaagtctcaactaaaccaggtagagtacagttcaaagtatgtgacacaatatgagaggcaaaaccacaaaccttgtctagaacaatgagaacaggatgcctggtctttagagggagcttatctggaccttctctgagcccagagaacaggcagggaaggtgaggctgaacaaggaaacacacacatttctgagaagcagtgtatccttgaggaagggtgaaggaaatggatctgaattatgagtaatccagcaattgctgatttctttgaactagagaaaaacgaaggttaaaatagtgtacatacacacacacacaccc

SEQ ID NO: 388733 - DNA, 829 bp, Homo sapiens
gccactagtagccaaattgaaacaggaacccacattcttagcttggcttcagtttctttccgggtcttactgagaggtgaagccaggcttctgggtgggtggggacttggagaacttttctgtctagctaaaggattgtaaacacaccaatcagcactctgtgtcaggctaaaggtttgtaattgtaccattcagggctctgtgtctagctaattgggtggggacttggataacttttgtgtctagctaaaggactgtaaacaccccaatcagcactctgtgtctaactgaaggtttgtaaatgcaccagtcagcactcggtcaaaagggaccaatcagctctcagtaaaatggactaatcagcactctgtaaaatggaccaaactgagctctgtataatggaacaatcaacgctctgtaaaatggaacaatcagcaggacatggatgaggccaaataagggagtaaaacctggccacctaagccagcagtggcaacccgcttcattccccttccatgctgtggaagatttttctcttgctcttcaagataaatcttgctgctcctcactctttggggcagcactgcctttatgagctgtaacactcaccatgaaggtctgcagcttcactcctgaagtctgcgataccacgaacccaccagaaggaagaaactcgacacatccgaacatcagaaggaacaaattccggacacaccatgtttaagaactataaaacacaccatgagggcccgcggcttcattcttgaagtcagtgaggccaagaacccccgaattctggacacagtactgctctggtctgagagagcct

SEQ ID NO: 388734 - DNA, 357 bp, Homo sapiens
aacaaatgtaactgtaatggtataccttctccagaaaagcataccaattctttaaatattaccagagatccacatccagtcagggttctgatttccctcaatgctctcttactattgtgttttgttttgttttgagacagggtctcgctctgctgcccagcctggatggtgtccagtagtgcgatcatgattcactgcagccatgaccactaggctcaggcggtcctctcacctcagcctcctgagtaactgggagtataggcgtgccccaccacacccagctaatttttgtattttttgtagagtgggggtttcaccatcttgcccaagcaggtcttgaatttctgattctgatct

SEQ ID NO: 388735 - DNA, 243 bp, Homo sapiens
tacacatcaggacatccggtgtgaattaagtaggtctccacaggagtctacgcatcaggacacccagtgtgaattaagtaggtctccgcaagggtctacacatgaggacactggtgtgaattaagtaggtctccacaagggtctatacatcaggacaccggtgtgaattaggacaccggtgtgaattaagtaggtctccacaggggtttacacgtcaggacaccggtgtgaattaagtaggtc

SEQ ID NO: 388736 - DNA, 323 bp, Homo sapiens
actcccgggatccctcccgcacgccctccgccctccgcactcctccctccccactcccgcccgctccctttgcttcgcccgccctctcctcctgcccggagccccgcagccgcccagggagccgagcctcgggcgcgtccacgtcctctccagctgaggctcttcccgggtccagcccggacctcatcctcccagcggcggggaccgaccaggctggccggggcggggtgggcactgctgctgccgctacccgagcaggacaataggggctttgtctccacagccggagagggccaatttcacgtttaatttgaggctaattc

SEQ ID NO: 388737 - DNA, 463 bp, Homo sapiens
aattcttttcattgttattataagtgggatcttttgtcattatatttcataatataaaattgactaacttatattaggattttggcctctcttcctgctgacttttcgtagtgttaataatagattttcagctgacactcttgaatattccatgtattacaaccataactttttcaaataatattaattttgccttcttttcatttttttaaactttatttctttctttttcctatttctttgatgagtctattccaacaggactaaattacagggtgatgatagactcctctgtgtcccgttccattctaagaagcattttagtgtttcaccgtggacaatgctgacttctgttttggtgtacgagggtctatatttttaagcacattaaagttgcatctgttcttccactattaagagcttacaacataaatgtatattgaactttattaaatgtcttgaa

SEQ ID NO: 388738 - DNA, 162 bp, Homo sapiens
tgtgcggtgtgtgtgaatgtgtgtatatgtgttgcagtgtgcatctgtgagtgtgagtgcctgtgtgtccatgcaagtgtgtatgcttgtgtctgtgtttacatcaggaaagcaggggagggaggcaggagtgaaccggggaggcctcagactttggggcag

SEQ ID NO: 388739 - DNA, 351 bp, Homo sapiens
gatagatggataatgtttctgatcatattgaggaaaagaatccttgcccttagaagccaagactccattcttaacctcatccccgctttctttaagatggggatagaaatcaggccatgattgaaaagtatgagatgacctgagagatccctgggttcattttgatcaaaagctgggacttcttatatatttctgttatttgcaggaaagacctttctacaaaaatctgtctctctttaaagcaacacagacagtttccttgtgacattaatagcttcttctgtgaatgtgacatatcaggtgataatctcctatccctgccagccacatccccaaaacgagcccatggag

SEQ ID NO: 388740 - DNA, 340 bp, Homo sapiens
aacagacttggaacagccttgggtagttctgatcttttgtgacccagcttcaccttagggatttgctgggagcccagttccaggcaggatggccatgagccagtgtctgtggaggcttcctcaagcctgctctggaagggctggaatttctgccctctcccacggagggaatgacgtggttgaggctggggcagccggcgggctgccagaggaaaaatccctgcctaatgtgcagctgaaacagtgatttctatgaggacttgctcaatcttcaggttgctaaagctgtcacagaaagctgtgtggacccccagctgttttttcttctctattcctgaag

SEQ ID NO: 388741 - DNA, 369 bp, Homo sapiens
gcgatgtaggaactgaaggtccaccaaccaaggaaaccacaccattgcaatccacagtgctgtgcatcttcccattcgctggaaacactgccagcatccgggatgacctactggtctgactcaggttgctgttgcgtctctctccgtgtcgtcggggcacaaacaaggaatctctacggctctcgttatcctcaaaggtgctgtgctcatcatctgcgaagtcgttctcagatcccacatcctttgctcgccctctaaagctgaaaaggcttgttctgctatttcgccttggtgaaaatagggagccacggatgctcaacaaagactagaagtttgaaagagcaaacaaataaagtcatattaatatgg

SEQ ID NO: 388742 - DNA, 793 bp, Homo sapiens
tttggcagagtaagaccaggtgccaatccccgaggtgtgtttctgctgctcttatacaccgaggcagacccatcagcttttgagtgttaattacctcttcctgctgttgtcatctgtacttgggagtacgaggcagaaataagctatcatcttctgcagaagacaattactgaactgattttccagagttggaattaaccttctgtggcctaatcaccttcatttctacttgaatccccggaatagtgaaaacaatgaccattgcgtgctgagtacctgctctgtcctggcatcttacaactctgttccaaagtctgtgctgcttccataggactgttctcacttctttccattttgcaagttctcagcctggcggcagtctccctgcccgagtggatggtgccaccacctcttactgaaggagcggtttctgagggagagtgcctgtgctgtgcagctgtctcccgcgaggcgccctttgacaagtgtgtcttctgtctcccctcaatgacactgtggcttcatggagtctcattgcatgcccagcacttagcacagggcatccctgcatggctgcgttgttccctgcatggctgcatttaggctttccttttcctgcaagtgctgcctcgtctttcctttctctcgtctcagcagcaggaagagcaagttctttctctgcctccccgctgcctggctccttcagctatcaccagccatcccctctacccagccctcactctggtgccacaattgctactttcctggcttcttcacggggacctgacatacc

SEQ ID NO: 388743 - DNA, 366 bp, Homo sapiens
gggagtgagggggaaagtaggtacatgtggtggagaaatggaagctctcccaatggttccatcagttccaccacactggcacagattctagaagtttcctatttctggagtaggacgcagacatgatgcatttcctactaagacagatttctatccaggaaacatcatttcaagttgcagtgccaggctcgaggatccttctccgtcattgcttcaagtgtggtgggttcagtacctcctttaatgtaagagctggcccgtcttccctacctacttgggacactttctagttttgaccttaagtagggtatcaggaaaattccgagaaagggaagacactctttttcctgaattacagaatagacc

SEQ ID NO: 388744 - DNA, 383 bp, Homo sapiens
ccaaaccaacacccgttggtctgggtgactgtgcacacagccagctggactgttttgactgaatcgacctaacacttaagcttattttttaatacattaaatttaatctaataaataattaggggaaaaaggagacgttcaactctgtttgattcaatgaattagctcttgaactaacctaaacggttgtttgaattgtttgacaagttcctttgtgtggtgagtgtgtctgtgtgttttcgtacaacttgcctgtcaatgcagtcaaaactgtgtgcaacatagacacagcttgcaaagtgttctgagaactgattactgtcagatttttttaatccattgagtcccagaggtgccatgtaaatagaaattttaattttatt

SEQ ID NO: 388745 - DNA, 807 bp, Homo sapiens
agaagtaaatgagccaccagataagcaaggaggtaataacagcttaaaccaatagccactcatggaagtcagagccacaagatgtgttgctccctatagaaaataaagataacatcttgacataggtccctgagttatttttcagaaactcagacccccgccaaatggaaagtgccaaccaccatcatcacataagggggaactgaagactgaactctgactgacgttcttcattctaaatttcttcctgaggggcctggagacagtgacacccacatgccaaaccttaacattcctttctgctgatcccaagtttctaggcaaagccttgcttccttaaccaatcgcaaatcaaagaatctccgaatcctgcaaccccacttcaagatatcctgccttttgggaccaaaccaatatataacccccacgtattgatgtatgattttgccaataacttctgctttcctagaatatatctctgcctttaaaaaatcttgcttgtaagccattggggaggtcaggttttaagcaatagctatcttattctacttgcttggtgccctgcaaacaaacacccctacttctcttgctacagacgtcagtgtcggtgtttggctttactgcactgggtgagtgtactcaggttcagtttagtaacaccgcaacttaagaaaaataaacctgggccgggggtggtggctcacgcctgtaatcccagcactttgggaggttgaggagggtggatcacaaggttaagagatcaagaccatcctggccaacatggtgaaacctcatctctactaaaaa

SEQ ID NO: 388746 - DNA, 183 bp, Homo sapiens
ttactaaattttgcaacttaacttttattaataacaagttacttgggatatccccacaacacatgttgacccataaatatacgaccacatcatggttgagagctactggtctaaagaataaacttgcttcttcctgctttatagagttcccgtaaaatacccttcaccctggcccccaggatc

SEQ ID NO: 388747 - DNA, 532 bp, Homo sapiens
aatgggggctcagtcccacaaccatgaagaaatggattctgccaacaaccagagccagcttggaaggagaggtttctccagttgagcttccaggcaaggacagagttggctgaacatttgatgtccaccttagcagagaactctgctaaaacatgctggagttctgacccaaggactgtaagattattttgtattgtttgaagccactaagtttgtgataatttgttatacatcaatagaaaatgaatacagtcacttcaggtgttttctttttgaaggtcagtttgccatttatattttcttagaaatcatctgtttcacctataatcttaactttacttgcatagaattgagcaaagtaatctcatttaaattttcctgaaattttaattttttccccattatcatttttgggtatttgtgtgtgtttttttttaatggccacttaaccatttctgatgaatttatctgtctccacatctatctatatctcttattaattatttccttttggccatgtaaactaaaaata

SEQ ID NO: 388748 - DNA, 783 bp, Homo sapiens
gacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctc

SEQ ID NO: 388749 - DNA, 457 bp, Homo sapiens
gaaatggaagtctcacattctttgtctcagccctcccaaagctaggaactggacactagaattgctgtgatgtttgctgcagaataatcatgtacctccaaaaccaaatttgccacaagaaacagtacaaatgcagccatcagttctgcttttgtaatgttgtgtgggtgtatcaggtttgtcaaagttagcttggtgtggaatttgaattgtaagggaaactgggatatttgagctttagttatccagccactggcatgctgtaagacatgagaaaggcaatttagaatggagttttcagacaatctacaacgtccacaaggagaaagggggacttcgaccttgcatccagacctgagatagatgaaatgtgggcaaaaaccaaaaacaaaataacagcaacaaagaccctaaagatgtagaaataaaataacagaaatggtctccatttgtgcaa

SEQ ID NO: 388750 - DNA, 438 bp, Homo sapiens
tactacattaaagaacagcactccaggaagaaatgaatagcatcagaaagggtatacatgtacataaacataaaagattatgtattatttaaagtaacaataataacaatgccttgtggagttacatgtagaagtaaaatatatgataatagtagaaatgatgggagcagataaatggacctttactcttgtttaattttttgcattatgaagtgctaaggtactaagtaaggaagattgtaataaattaaggatgaagggtttctagagcagggtttcttaaccttgtcacttttgacttttggggctggataattctttgttgtgtatggctaatctttgtattttaagctgtttaatggtatccctggcccctacccactagatgccagtagcaccttccccaaaatgtgacagccaaaaatatctctagacatg

SEQ ID NO: 388751 - DNA, 433 bp, Homo sapiens
tcacccaaatgtgtgggagtttctccccaccaaccaccagttcttcagtagagatcaactgggagtcctacaatttaactctattctgactctatctacctggagaaagcatcagatcacacaggttaagggctcagtcccacaagacttccccccaatgtcagatgccaatcacaagtagtaggttgtcacacctatacttctgaccaactagctataagttgggggtccacaacccccttctcaggttcagttaatttgctaggtaagctcacagaaccacagaaaacacttgcttatatttaccagtttattatattaatgaaggatgtaattagggacacagatgaaaaacagttggaagagatgcaaagggcagagaatgtggaaagggatacagagcttctgtgtcctctctagatacgccaccctc

SEQ ID NO: 388752 - DNA, 83 bp, Homo sapiens
aaagtgaatagtgcaaaatatacagtgctacaactaaaaatttagaaactgactatatgtaatttatataaaataggatgaaa

SEQ ID NO: 388753 - DNA, 426 bp, Homo sapiens
gatataccatgctaatgtttcatagaatttctcagataagggacaaataccaatctagggctgcctatacaaatgataacaattcctgacaatatgcaacagacagacaagtcaaactatacttcagaaatagttttcaagcttgcaagtctttttttctggaaataccagtttaaagtgaagtctttaatgctctttacatctttgaggaattattagcattatcagaaccagaacgcccacctgttcccagggacaacctcaagaatccaggatgaatatgaagaaaactccattcattcgtctaatcaacattcatcaagtcctttcttatatagggcttggcaataagggatcaataaacaaagtacaatgtgcaactatgatgccacaatatgggcaaagcacattttcaacagaggttaa

SEQ ID NO: 388754 - DNA, 348 bp, Homo sapiens
gtagaacctgaatattttcttctaatggaaataaataacaaatgtataggagccaagtgtttaaatatttgttatttcaaatgtaatagtttatctactgcttatgtttgctaagaccgacatattttatctgctggatacatttgctaggacagcattgacttttgtgcatttattttataattggccatgtactgagctgacttagaccgtgactaataggttttcagatggttcttttgagagttcttgctagtcatttacatcatttttatttctcttttacaatatgtatatttcaatctgcttatatattaacccttctgttggtggttttaatgacatctg

SEQ ID NO: 388755 - DNA, 1123 bp, Homo sapiens
atgtgacacatactataaaaattatgtcaccattcaaaaaatccagatgcatatttgaaggactaagtgggaatgataaagacagaatgtaaacaaagtctccagaagtttagctatgaagtgaaagacatgttaagaatgaccacattttgagaaccatactgctatagatcaatttgtgaaaaattgacatcttttcaatccataagcatactgtatccttttaggtacctaggtcttctttaatttctcttggtaatgttttgtagttttctggatagaggtgttacacatttctcattacatgtatttctaggtacttcattttttttatcctattataattttattttccaattgtgactaatatatggaaatactttcatatatttatctttatctaaatacagttgacccttgaacaatgcgagggttaggggcgctaaccccctatgcagtaaaaaaaaaaatctgtgtataacttttgactccccagaagcttaactactaataacctattgttgaccagaagtcttactgataacataaacagtcaattaacgtatattttatgttatatgtattctatactatattgttacaataaagtaagctaaggaaaaggcaatgttattaagaaaaaataaggaagataaaatatatttactatatattaagtggaagtggactatcataaaggtcttcatccttattgagtaggctgaggaagaggaggggttggtcttgctgtctcaggtggcagaggtgaaagaaaataatgtatataagcagacttgcacaattcaagcctgtattcaagagtcaactgtactttgctatattcatccattaattctaatagtacatcagtaaattaacttggattttctgtgtacacaatcttgtcatttgtgaaaaaggagagttttatctccttctaatcctgtatcttatatggatatatgtatgtgtttgcattgactgggacctctttcacaattgtgaataaaagaagtaatagcagacctctttgtcttattcccaatctgagtacttcactattaaatataaacatcctttgtcattggagaaatgaaaataacattacacatccatcaaaatt

SEQ ID NO: 388756 - DNA, 435 bp, Homo sapiens
gaagggatttctttggggctttgaatttgccacatgcaagataaagttgtagattcagaaaagagagtgaatttgttatctgtgcatacctttcttcaataaaaccgatgggaggatagtctggtctcttacttactcttgattccttccctccacaaaactacaatcccttctatatacagttatgcatcacataatgacatttcagtcaatgacagaccacatatacaactgtggtcccataagattacaatgcagctgaaaaattcctattgcctagtgatgtcctagcctttgcaatgcattactcaggtgtttgtggtgatgctgatataataagcctactgctttgccagttgtataaaatataacagatacagttatgtgcagtacatagcactgaataatgataataaacaactatattactggttt

SEQ ID NO: 388757 - DNA, 404 bp, Homo sapiens
cttgaactcctgacctcaggtgatccccccacctcggcctcccggagtgctgagttacaagcgtgagccacttacacccgaccagtaatgataaattctagaaagcaagggacactaagtcactgagatgctttagtggttattcacactttactttttaaatgaactgttttcagttaaaaaaaaagatgattggttgtgtttgtattttaagttatagctagtgtatttttttaatgagatactccattcctattgaaagcgggtgtattttaacaccatgtgactaatgctacacttgtgaataatctcattttttgaattgaaaatataaatgtttaagttttataatttgccactttgaagttctaatgttactcatttgctcatgttgaacagggatt

SEQ ID NO: 388758 - DNA, 225 bp, Homo sapiens
cactgccatttggaactctttcagtacagtgttttcatatttacttaaggacatcttaaccaaataggctaggaaatagtttgctagtataccattttccacaactctttacatggtttttaagtgtttatgtgtaaatactattctttataaaaggttcagtttcatcacatattggggaccatgatgctttacaaattctgttcaaggtaaagtcttaattgt

SEQ ID NO: 388759 - DNA, 594 bp, Homo sapiens
tcctgcccggaaggatgcatggcccggggtctcctgcacctgagggtgggcgggaggcggccccgcgggttgtgttgctggaaaaaggggtctcgatccagaccccaagagagggttcttgggtctacttcagggaagaattggaggcgagtcacagagcgcagtgaaggaagcaagtttattggaatctactccgttagagagtgcaagtcctcagactgcaggaggaggaactcccgtccttcggtagtgtcactacttagaggcaactgtgaggagctgtgattaatcgtggaatgtgctgatgtgcccactaaagaggaataacgccagaaagtgttccagtacaaccagagaaagagagtccatgagaaatctgcccttgtgaagttggaatcccctcaacctcaccccgctgacttgaatgaagcgactgagacgggctatgatggagcagatccggttgctcgaccttctcccttgcaccaacacatgtagttaatagttactggacatgcatattcagtgggttccaggtaccaaacttgtattgaatggtatgtgccagacaccgtcttgagatctggagaataa

SEQ ID NO: 388760 - DNA, 848 bp, Homo sapiens
tcctgcccggaaggatgcatggcccggggtctcctgcacctgagggtgggcgggaggcggccccgcgggttgtgttgctggaaaaaggggtctcgatccagaccccaagagagggttcttgggtctacttcagggaagaattggaggcgagtcacagagcgcagtgaaggaagcaagtttattggaatctactccgttagagagtgcaagtcctcagactgcaggaggaggaactcccgtccttcggtagtgtcactacttagaggcaactgtgaggagctgtgattaatcgtggaatgtgctgatgtgcccactaaagatgcctggtaagcagtggctcctctaacaagtgggcagcttggaactgggaacgagagagccaccgaaacagaatgagggagacaaagaagtgggcatcacccttaactccacaagggcttcccaagggcgctgtaccgtacgcaggcccaggacgaactttatttctcgccccagcatcgctgtccttgtcggtgagaccctggctttagggcagacaggaccacgtttcataagttcatgctgtcccagcagaggaataacgccagaaagtgttccagtacaaccagagaaagagagtccatgagaaatctgcccttgtgaagttggaatcccctcaacctcaccccgctgacttgaatgaagcgactgagacgggctatgatggagcagatccggttgctcgaccttctcccttgcaccaacacatgtagttaatagttactggacatgcatattcagtgggttccaggtaccaaacttgtattgaatggtatgtgccagacaccgtcttgagatctggagaataa

SEQ ID NO: 388761 - DNA, 472 bp, Homo sapiens
gagagtccatgagaaatctgcccttgtgaagttggaatcccctcaacctcaccccgctgacttgaatgaagcgactgagacgggctatgatggagcagatccggttgctcgaccttctcccttgcaccaacacatgtagttaatagttactggacatgcatattcagtgggttccaggtaccaaacttgtattgaatggtatgtgccagacaccgtcttgagatctggagaataaaaaaataaaaaaataaaaacgagacatccagagcacagtagccttgcggtcttcctggaactagagaaaattcagcccttctgctccttgggaagctatgtttgggaaaaaaaaaaaaaagagagagagagagactccaaagagtttgttattaaatttaagttcaaactaggtgtatatagtacaaaagttcttaccatgcatttaatcttaaaatgtgctgatatctagaaccct

SEQ ID NO: 388762 - DNA, 477 bp, Homo sapiens
gacttggtgggagatgtcctgtatggccataaatattgtgtaattataattgttggtcagcttagaatgcggctattttcagacctttagcattaaccttataggtgccttgtgagtgcctagttactcactttaacatgcagtcgctctagccatgttttattaaaccagatgcctggtaagcagtggctcctctaacaagtgggcagcttggaactgggaacgagagagccaccgaaacagaatgagggagacaaagaagtgggcatcacccttaactccacaagggcttcccaagggcgctgtaccgtacgcaggcccaggacgaactttatttctcgccccagcatcgctgtccttgtcggtgagaccctggctttagggcagacaggaccacgtttcataagttcatgctgtcccagcagaggaataacgccagaaagtgttccagtacaaccagagaaagagagtccatga

SEQ ID NO: 388763 - DNA, 483 bp, Homo sapiens
catttccagtcatgcctgcaaagattgagtggactttaccctctccccagcagtaatgaagcaccccctctctttccctgctctacggtactgtcccagaagaggctgagtagagagcgaagactttcatcactgccctgcagtaatggggccaccatcaccactacccccatattatcagtaaaggtcatgtggggagaagtagcaagggactcaccacttgtcccagccaagatggtaacagtggaagcctagtacagagtcagaattccttcccctacccagcagctatgaggagccccttcatcccttgggtgtcaacagaagtcaaatgggtaacttagactctaccctacgtggccatagtgaaaaaaacatctaaaacataaagtttaagtaagatccagaatctcataacataatactcaaactgtccatgttttagttgcaaatcacttgtctaacaaaatctcaacttgactg

SEQ ID NO: 388764 - DNA, 1888 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388765 - DNA, 2185 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcataaaaaaaaaaaaaaaaaaaaaaaaaaaaaaacttcggagaattgggaagagagagagaaactgattctctcgagagggctttagtgggggggtgcggggaaaagagagaggtaggaaagggcccaaggggcgcaatacgcgtgtgttcccggggaccccacggttttttctcggtgtccaagagggggtagacactctggcgcggggtttccccctatatgggggggctggcgcgtataacatttcgcgaataaagcccgagggttaacgcggggtttaaggaaccgcgggggggaaa

SEQ ID NO: 388766 - DNA, 1766 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388767 - DNA, 1611 bp, Homo sapiens
  misc_feature (1458)..(1458): n is a, c, g, or t
  misc_feature (1466)..(1467): n is a, c, g, or t
  misc_feature (1469)..(1469): n is a, c, g, or t
  misc_feature (1482)..(1482): n is a, c, g, or t
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggttccccngggggggnncngggggggggggcntttacaaaacaccacaacagggccgcaggcagacaagaacggggggcacgaacacccacgaggggaaagggcgaccgcgaagccccaacaggagagggccgccccagagccaaaaacactaacgtaccg

SEQ ID NO: 388768 - DNA, 1777 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388769 - DNA, 2494 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagagttgttccctgcctgtcccagggagcctgcccttggccaaaatgagaaaaaacaaggatgatgacaggggacacagcggacccacatgggcacctctgggacaagagattttgcttgagacagctcccagggcagcaggagtccctgtctgtgctacaggattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388770 - DNA, 1848 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388771 - DNA, 2158 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagaggtgagggcagagccggggcggggccctagcggggtgtcccggcgacccagaccttaaagggcttctcttcttgcagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaacggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaaaaaaaa

SEQ ID NO: 388772 - DNA, 2082 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaacggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaaaaaaaa

SEQ ID NO: 388773 - DNA, 1408 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388774 - DNA, 543 bp, Homo sapiens
  misc_feature (35)..(37): n is a, c, g, or t
gacccgatatgatccccgcgaatcctcctcctccnnngcgaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388775 - DNA, 317 bp, Homo sapiens
gacagcatctgggctgggtggctgctcagggccctccagttatgacatttatctttctctggctcagactctagcaggatacccaggagaaagagggaagtgctggctaaggtcccaggctttgggcgtgtatcagaactatccctatccccctgctcctgtccgggatcataatttgtcgattgttcagcctttcagacccccactggcatgccatatggaacagtgaacttacttcatggcgtgaacccaggagagacccctgtcacctgtacggcagggattgggaccttcattgttgaatttgccaccctgag

SEQ ID NO: 388776 - DNA, 517 bp, Homo sapiens
taattaacatttattgagtgcctaatacatactagttactgggctaagcactttcctccacgatatctcatttaatcttcatagataaaccctatgaaatagatgctattattacccctaatttaggataaagaagtggaagactctgaataagtttgccaaacttgcgtgattcataagtgatagagctgaatcgatttgacttcagaacccatttttttctaggatgggggtgagaaaagagacagatttaagagacaatgggcatacaagaagagggaaaggagtttggagtgatggcaaatcgagaaagatggatggtagcatcttcacagaaacggagtcctcatgtggaggaactggcttgaaggaggtgacaaggagctcggttttagacttgctgaaactggggtgaccacaagatctgtgagatgggtatgggaatgagttctcgaagaaggtggagaatggatattttggacaccttcaagtaaatacggtagttgaagctgaaagc

SEQ ID NO: 388777 - DNA, 362 bp, Homo sapiens
gagtccctgtctgtgctacagggtaagccgaccccaatcccagagaccacagggtcgggggcaaggcccatgcaggctcagtgagcaggggtggcatccgagacccggccagcacgctggagactgcctgacacctttttggctttggcagagagccagtgggcattgatgaacccattggccttgtctagggctcctcagtgacaagcagggctgcctccgccgtactgtggagcaaggcaggccaagccctaggaactcctgctggagacagtgaagggcgggccagtgaaggtcaaaaagggagccccctcagcttggggctgctaccggtaggggtgtccttctaagagcagtgtggg

SEQ ID NO: 388778 - DNA, 1073 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctggatgggggtgagaaaagagacagatttaagagacaatgggcatacaagaagagggaaaggagtttggagtgatggcaaatcgagaaagatggatggtagcatcttcacagaaacggagtcctcatgtggaggaactggcttgaaggaggtgacaaggagctcggttttagacttgctgaaactggggtgaccacaagatctgtgagatgggtatgggaatgagttctcgaagaaggtggagaatggatattttggacaccttcaagtaaatacggtagttgaagctgaaagcaaagagttgaagagagcaaaaggccaagagttccatcctgagacatacatattcagagcctgagaaaagtcaagccaaaagtgaatctaaagattgtccaaaaagactgaagaatcaggattgtggagtatcaccggaaagaaga

SEQ ID NO: 388779 - DNA, 1895 bp, Homo sapiens
  misc_feature (1878)..(1878): n is a, c, g, or t
  misc_feature (1885)..(1885): n is a, c, g, or t
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttattttatatactcaggcaacaataaaatacatgacgactcntctctcnccctcccctc

SEQ ID NO: 388780 - DNA, 1834 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388781 - DNA, 1877 bp, Homo sapiens
gaagcgtgaacccggtcctttccctttccgtccatcccagaccccgacttgctccgacacagccgctaggtcccaggagaaatcagctagtgattcccactttccgccctgtatcttgttcttcccccgcttgtttttgtgttcttgccccatgcctgatttctcgtcccccacccagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388782 - DNA, 1746 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctgagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388783 - DNA, 2045 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaacggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaaaaaaaa

SEQ ID NO: 388784 - DNA, 1534 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 388785 - DNA, 1953 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaacggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaaaaaaaa

SEQ ID NO: 388786 - DNA, 1080 bp, Homo sapiens
gtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggcgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaaaaaaaa

SEQ ID NO: 388787 - DNA, 1239 bp, Homo sapiens
catcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaaggacctcaagggcctccaccagcagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttacaaaacaacaaaaagacgaaa

SEQ ID NO: 388788 - DNA, 1215 bp, Homo sapiens
catcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcccctgcctgtgcacagccagctgcatctactcaggccccaaggggtttctgtttctattctctcctcagactgctcaagagaagcacatgaaaactattacctgactttagagcttttttacataattaaacatgatcctgagttacaaaacaacaaaaagacgaaa

SEQ ID NO: 388789 - DNA, 703 bp, Homo sapiens
gagggtgggaagagagagagtgttaggaaaaataactcatgagtactaggcttaatacctgggtgacaaaaaaatctgtacaacaaacccccatgacatgtttacctatgtaacaaaactgtacttgtacccctaaacttaaaagttaaattttaaaaaaagatattttcttctcctttgtttgattgtactgttaaagacaaaatacaacaaatttagtttgaagatctaattggcttttatttgtgattctagaatcaggcaacacttcattctatgaaacagaagtagtgatccactggatatgatagaatggttggtttttgtaaggtgggaataagacaacagaacgataaataaaagtgcattgatagcataagttactacaagtcacttttcttgtaagagttaaaacagagaagacctctttattatgctgacttaggaagattgagctctttgactagttgctgtgaatctcctgttttcaggaaaaactgctctgtttggggctctatcagcttccttaaagttcagtttgattatgaggcactttgcatgagtgacactattttggtctggtctggtctgtgggagtctggtgcagaaggctggtccaaaacaatggattcccataaactgtaacagcacttagtcataaacatctctttcagaattatgttcagcatgtgaatgtccctga

SEQ ID NO: 388790 - DNA, 399 bp, Homo sapiens
agagatctactaagcttattaacaaaatcattctgaaacctttacacaaatcagcctgctttaaataaaaaggttagaaacattatgataactatgtacaagagtatatatctgtatactctaacattctaaataaaggtatctttgaaaatttactattatacagtattagtaccatactctataatgagcaaagaaagaatatgagaactcttgggctcagtacagtgtaaatatgttcaaaatgctatagaagtgttctctttgtcctgagctacttttttgtttctcttatagtgttctcttgtattattcatttgcttagatatctatatgcttattgttaattcaaccacaaatgcgcttcctattgtttccgctgattgagttaacttatca

SEQ ID NO: 388791 - DNA, 789 bp, Homo sapiens
ggcgggcatctgtaatttcagctactcaggaggttgagacgggagaattgcttgaacctgggagacggaggttacagtgagcctagactgcgccattgcactctagcctaggcgacaagagcgaaactatgtttcaaataataataataataataagacttaccatttgccaggtcctgtgcaaagcactttatctcatttgatccctgggaaaccccataaagtactattatgccatttctcagataaagaaactgaagctcagagacgtttagttgcttgcctgtggatataacactagagagcgggagagcacagtatttgaacccaggaggtctgatgctggaggtcatgtttttaaccttatctctgtattgcctgcccaagtgctggctgtgtgcatgtattctcaataatccctggccaacttcctgctttgctgtcagtagcagagctgaagaacttacaatagacggcagagggcgtccagagtcactatttttaaaaggtgctagttttcaaaagcatttctggaattcagagagaacagaggtccacatagcaggctagacaggaaaggtagctgtagatagactttagggagtatatagaatattgccttcacgcaggttaagaaatatttagtgttgaaaggatacttttaaaagagagaaagcagtaaagttgatcctctgcagaaagtagaccaatgtaagtatcatgcaatgtgtccatgtgcgtgtacacgtgagcacacatgcacacacacattagatgttttgtgagaaa

SEQ ID NO: 388792 - DNA, 129 bp, Homo sapiens
gattgctcctctgaaaactcaatattggaagctggtgcttgaggacaagccctggcaggccgagggcacctgctcctctgtctgccctcctggaaccacgcgtcgggtcacaggccgctgggcagaggt

SEQ ID NO: 388793 - DNA, 221 bp, Homo sapiens
gcactgtagtaggttcttgatgatacagctgagatcaaggtagacagatccctggtctcatagaccatctattctaatggggggcattgataatatagttataatgaaatcataggcgttgataagagtgccgcaagaagtaaagagggtgatgaggatgagatgaatcagaggaggctgacttaaaaatggtggtcagcacaggaccctctgaggaggca

SEQ ID NO: 388794 - DNA, 587 bp, Homo sapiens
tttgaattgccatatgtcacatctttgattcctgactcaaataagagacaccatagtgtaataatagagagtgccggagatgagagcttgcaggcctcgggccgcatccccgcccacctggaggagccatttcacattcctgggtctcaggtccttcatcctctaacaagatacgtggtccctgaaaatcactacctgaaaaatgggtgttgagatctgacttcccaagtggaaggaaaataggaccctatgtatatgctatgaggttttctctaaccctcaaaccataaggggttccccagaaagagaaaggggagcccccaaatgatgaatggccatgataccggcagtgggcagcttcaggtttagctggaaaaacaccagctcataaaaagcacagctcttcagcactggcaaaatacaatcccatccagagagggataatggggccaaagtctccagaacattccacagaaaacagaactgggcgctgttctatctccaacttgctcagtgccccccggagaaatccctcgtaattagtcaccccttccatttcctcctctaaagatggaacacagataaca

SEQ ID NO: 388795 - DNA, 204 bp, Homo sapiens
tctctatggaggataatgtgaaaaaacagattatttcaaagtcaacagtatttcatttggaaatatatatgtctttctgacaccttcgctttcgttcccagctcctgttaggtcagcctgtcattagttgccaatggtgtggcagtgccaactgctggctggtgtgagaaagagtctctgggtggctgtgggtaatgtgtattg

SEQ ID NO: 388796 - DNA, 498 bp, Homo sapiens
gtctgtaaagcactgatggactcaaaagtactgaaatgttaggttctcagctttgctgggagctcattgggggacgctgggaaagtcaccctggggtgacttctctgatgtttggctttttccagtttgtgctgtctacctgcttgttgagggtgacccacccctgtgttgctgttgatggagaccctgcagactctagtccatgctctggtctgacttctgtaagcactgaagatgggctgaaccatcagagcttttgataaggatcagaataattccctaaaagtgtgtggagctgcacacagagattgtcttaaggtgaccctgggaggatttggcctgaagcaagagaaaaactggcaagggtcaaaagggctttggggaggaaaggtgtaacgtttctgccaaaagcggaacctaaaacggggagagagaggcacctgctcaatagttccatgcatgggaacataatacttttaagaattgcctcagagtttt

SEQ ID NO: 388797 - DNA, 191 bp, Homo sapiens
ctgaatatgacccaccccaagtccgattgaacaaacaggttgtacaaactcttttttcaatattgtggagcaagaaggaaataaaaatgaatgaaacaagatccttctattcaagggacatatttaataaggtaaataatagctaaaggcaactataaaacagaacaggatagtttagtaagagtaaagga

SEQ ID NO: 388798 - DNA, 1309 bp, Homo sapiens
  misc_feature (45)..(45): n is a, c, g, or t
  misc_feature (92)..(92): n is a, c, g, or t
  misc_feature (402)..(402): n is a, c, g, or t
  misc_feature (410)..(410): n is a, c, g, or t
  misc_feature (435)..(435): n is a, c, g, or t
  misc_feature (577)..(577): n is a, c, g, or t
  misc_feature (621)..(621): n is a, c, g, or t
  misc_feature (636)..(636): n is a, c, g, or t
  misc_feature (643)..(643): n is a, c, g, or t
  misc_feature (645)..(645): n is a, c, g, or t
  misc_feature (649)..(651): n is a, c, g, or t
  misc_feature (653)..(653): n is a, c, g, or t
  misc_feature (727)..(728): n is a, c, g, or t
  misc_feature (822)..(822): n is a, c, g, or t
attctgagccaagtccggtgccaagcgcagctagctcagcaggcngcagcggtggcctgagcttcaggacagccagctccctcccggtctcnccttcctcgcggtcagcatgaaagccttcagtcccgtgaggtccattaggaaaaacagcctgttggaccaccgcctgggcatctcccagagcaaaaccccggtggatgacctgatgagcctgctgtaaaacatgaatgactgctactccaagctcaaggagctggtgcccagcatcccccagaacaagaagtgagcaagatggaaatcctgcagcacgtcatcgactacatcttggacctgcagatcaccctggacttgcatcccactattgtcagcctgcatcaccagagacccgggcagaaccaggcntccaggangccgctgaccaccctcaacacgganatcagcatcctgtccttgcaggcttctgaattcccttcggagttaatgtcaaatgacaggaaagcactgtgtggctgaataatcatgacttcttttttttctttgcacaacaacgacaacaacaaattcacagaaccttttnagcgctgaacttatttttcaaccatttcacaaggaggcagttgnatgacttttaaaagnaaaaaangngaannnanatgaaaaagacttttaaatgccctttctgcagttggaaggtttttttcatatactattcccaccatggggagcnnaaacgttaaaatcacaaggaattgcccaatctaagcagactttgccttttttcaaaggtggagtgtcaataccagaaggatccagtatcagtcncttaaatgaagtcttttggtcagaaattacctttttgacacaagcctactgaatgccgtgtatatatttatatataaatatatctatttaagtgaaaccttgttaactctttaattagagttttcttgtatagtggcagagatgtctatttctgcattaaaaagtgtaatgatgtacttattcatgataaactttttataaaagtttaaacttttagttgtaaacgtaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaataaaaaacattacccagtgtttggtggtgcacatctatagtcctagctacccccgaggctgagacgggaggatagctggagcc

SEQ ID NO: 388799 - DNA, 420 bp, Homo sapiens
tgctttctaggtgtcaaatatagccaggcccctccccactgccaccctaccccccgggcaaggcgtttgtcatcggctctctctcctgggccccagagacacctttgccctccatctatgacccgttagatagaggaggcaccaacttcagggtgggcccctttagcctctcccttcctcagtggcttccagtgccacccgctctggtctgggggaagaacttcaactccagactctgggcccagccccccattcctgaagctcagctgcttcccaggttaaacctccattttccctaaaatctgtgccagtgggatgctaagaccctatccactgagccacccgatcccctcctcaggccggggccctgtcccctttcacagctagaggccttcgcagacgggacagtttgcacctcat

SEQ ID NO: 388800 - DNA, 337 bp, Homo sapiens
aaccaatcagagagattaaggtgtcaataaatgaagattaaaatgtcagctcagcctgggcgcagtgactcacgcctgtaatcccagcactttgggaggctgaggcgggtggatcacctgagatcaggagtttgaaaccagcctgggtaacatggcgaaaccccgtgtctactaaaagtacaaaaatcagctgggcgtggtggtgggcacctgtaatcccagctacttggaaggctgaggcaggagaatcgcttgaacccgggaggtggaggttgctgtaagccaagatcgcgccattggactccagcctaggcaacagaacaaaactgtgtctcaa

SEQ ID NO: 388801 - DNA, 257 bp, Homo sapiens
gtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaact

SEQ ID NO: 388802 - DNA, 275 bp, Homo sapiens
ccacctcagcctcccaagtagctgggactacaggtgcacaccaaccatgcctggctaatttttgtgttttttgtagagacagggttttgccaaagagcagggagtacaggcatgagccaccgcacctggcctgaactgaactcttagacattgtcaccccttgggttaaaaccttcctgtgttctcccatcatacacagtgaaacccaagctccttccacagcttaggctctgtatcctatggcttcttgccacccctgtaaccccaccacaacc

SEQ ID NO: 388803 - DNA, 792 bp, Homo sapiens
cttgttttcggtattgagaatagcaaatatagaaatcccttaattctttgacttagcttagcaggtgcaattagttctatccctaagccttcttaccagaaaattttctagtgtaaaatgattggatgggataccaattgggatgggtgtggtaatagtaaaaccatattctttaataactttttcttatttgttttcctggaattttggttggcattttttaatgaattacatgcttatttttaaaaattattatgatggagaatttttgttaggcagaatttcaaatctgtcatctgctgttgactcttactttcactacaaatttacgaaggtagagagacccagttcttacttaagttatatctaacataaaaatacaattctgtcccaatctgttcatttaaagggtaaatttatagcatctgttcaactttatatgctatctcaaaattgtcaacattttaagcaaggtgctacctaattttaatgggtgcacaagagggaaaagtgggtcattgacttcaaaggcgaaactataagctattaatgggctacgttgtgctgaattacaatctcttttcttgtttcaagttaaaatttttaagtggccacatgtttggcattgtaattgataccacaatgctgctgttccttgactcattcattctcaaatgtatatatatatatattcttagttcacaaatttctatttcttttacacaagttgctatttcttgtagtgttcatgaactgggtatgctgtcctttgtaatgaaagactacagactg

SEQ ID NO: 388804 - DNA, 505 bp, Homo sapiens
aggaaatgacttcttataaggtcattgcgctagatgttaagtgatacagtgttatttgaaagaggactaaatacaactaaaacaatataattagcaattacaactaattctgttgtaaatgtatattacaaacttaatagcaaccattaaaaagagtgacaaaaaagtataattgatatactaagagaggagataaaatgaaatcacatagaacgctcaatcaaagccagataaggcaaaaagagtagaacacaaaaaaagggcaaaaaatacagtaaatattaacctaattatatcaataattaattgttaatgtcataaatacatcaataaaagactatcaaagtagattaaaagtcaagacccaactacatgttgtctataaaaatcccactttacactttaaacataaagacgaagataaattaaaaggaaaaggatggaggaaagacataccatgctaactataatcaaaagaaagctggagtagctgtattagtttcag

SEQ ID NO: 388805 - DNA, 2393 bp, Homo sapiens
cgccggctctggctcagcggcggctccggtggcagcggcggtggcggctaggcgggctcggcggctcctgtccctcgggcggctgcccgctcgctgcccagggcgcccggacacacgtgggcggctcagcgatggcccgcgccccgcgacgtggcgggcaggcaccggggcgcgggaccgctgagcccgagtgagccggggccgcgctcccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgatcctctctggctgggaagggggaaggtaggaggtgaggc

SEQ ID NO: 388806 - DNA, 1630 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388807 - DNA, 2626 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggtttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388808 - DNA, 1997 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcaaaaaaaaaaaaaaaaaaaaacaaaaaaaaacaaaaaaaaaaaaacacctcgggcggcgatccatctatttgcggggggcgagcgagaaaagagaggggatagagaaaagacgcgcaaacgtggcccaaataggtgttcccctagcgacccagcggttttcttgtgcacaaccagggggggaaacactcgcgcgcgggctctccccccaatatagggagaggctcggctttaataactttctggcgaaaaaagacccgcggggttataaccccgggttatactagagatgacaccctccgaaaaaaactggagcgacgatagaaggaccacgacaagaaggagaccggacaccgaccgagaagaacagaaccagacgaacggacggagcacgcgagcacagatgggagcaacacgaaagaaggggcagacgagcgagaagacacgaagaagaacaggggggagaaaaaccagacagcccgacatagcacgccagaccaccggaaacagagcagaaagaaacagggaaggtacccggcgaaagacagcaggacgaacaggcaagctgcggccacagacagagccgggaggaagacagagcgaccgcagagacgcagaggggaaagcaacagacgaacagacggcagaagaaagaagggggagagggcgaggggggagaagagcggggacagagggggggagagagcgaaagaggagaaggggagaagaggagaggggggaagggggccgagaaaaaaacgaaaagggaggaggagagcgc

SEQ ID NO: 388809 - DNA, 1494 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgagggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388810 - DNA, 1558 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388811 - DNA, 2705 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggtttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388812 - DNA, 1481 bp, Homo sapiens
cagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388813 - DNA, 1770 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatgcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388814 - DNA, 1349 bp, Homo sapiens
tgattcttggtgtgggggcgggttctagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388815 - DNA, 1560 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagttcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388816 - DNA, 1067 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccaggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388817 - DNA, 1090 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagttcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaaggtcaattcacaccacaggccatccttggcccaagtggcacggggcatgatccttctcgcgcgggggggcgtgggtccaagccaaccacatttggccaatggcccaacctccatgcggaacgggggccgaacaaagctgtttacactcaaaccaggccaagagttttgaagggcctgacatcacggggcccgacacaaggaggtggtcctgtggacaaacacgcgggatggtaaccgtcagggcttggtgagcgcgcctggtgttcc

SEQ ID NO: 388818 - DNA, 637 bp, Homo sapiens
tcgagctcggtatcctgcatgatatgcatccatcttctgggcaaaggtttcagccacaagcagggggaagaccagggaggcgtctgcatagaccttgacggcctgtgcatccacccggatcttgtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388819 - DNA, 1662 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388820 - DNA, 2138 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcaaaaaaaaaaaaaaaaaaaaacaaaaaaaaacaaaaaaaaaaaaacacctcgggcggcgatccatctatttgcggggggcgagcgagaaaagagaggggatagagaaaagacgcgcaaacgtggcccaaataggtgttcccctagcgacccagcggttttcttgtgcacaaccagggggggaaacactcgcgcgcgggctctccccccaatatagggagaggctcggctttaataactttctggcgaaaaaagacccgcggggttataaccccgggttatactagagatgacaccctccgaaaaaaactggagcgacgatagaaggaccacgacaagaaggagaccggacaccgaccgagaagaacagaaccagacgaacggacggagcacgcgagcacagatgggagcaacacgaaagaaggggcagacgagcgagaagacacgaagaagaacaggggggagaaaaaccagacagcccgacatagcacgccagaccaccggaaacagagcagaaagaaacagggaaggtacccggcgaaagacagcaggacgaacaggcaagctgcggccacagacagagccgggaggaagacagagcgaccgcagagacgcagaggggaaagcaacagacgaacagacggcagaagaaagaagggggagagggcgaggggggagaagagcggggacagagggggggagagagcgaaagaggagaaggggagaagaggagaggggggaagggggccgagaaaaaaacgaaaagggaggaggagagcgc

SEQ ID NO: 388821 - DNA, 1521 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388822 - DNA, 1741 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388823 - DNA, 1900 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388824 - DNA, 1627 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388825 - DNA, 806 bp, Homo sapiens
  misc_feature (771)..(771): n is a, c, g, or t
  misc_feature (790)..(790): n is a, c, g, or t
  misc_feature (804)..(804): n is a, c, g, or t
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagaggggttgtaaaagtgggacgccttctaaagaatgattcgcccggggnttggggcaaagggaggatntaacaaaccccaanag

SEQ ID NO: 388826 - DNA, 944 bp, Homo sapiens
cggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatcctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatgcggtcagcaggcaggctctgttgggtgtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcac

SEQ ID NO: 388827 - DNA, 809 bp, Homo sapiens
ctcccatgacacatggggattatgagaactaaaattcaaaatgagatctgggtggggacacagccaaaccacatcaaaaagtgattcatttgacatggtcttccctatcttctctcatttagggtaacattatttccttgaatcaaaagggtatccctgtagactttgagttcatcttgacatctttgaaccatggattatcaatttgcaaatgttatttgttgaattattgagctatattccttgaaatgcttttaagaatgatattttcattaaaataaatgagggactcgaatcctgatatttaggaagatttctcaacatcatcacatacaattatgaattattatggacacaacagtggtagtttggatttttattgtggttaaacttagaaagtacaaagtattcataaatctacattttaatattttataattcaaatgaattttaagtaactattttgatattctataaataaaaatgtcacctatactatataaggattcactcacttctctctgcattctcatcaatacctgatgtgttgtgacttttaaaaaatagccattctgactagtataaggtgacatttcattgtggttttaatttttatttctctgatgatgagactgagcattatttcatatgtttgctgtccacttgtatgtcttcttttgagaaatgcctgtttatgtattttgtccattttttaatggggttatctattttgttgttgttgttgagttgtttgaatttcttgtcgattctggatattagtacttagttggatgcatagtttgcaaata

SEQ ID NO: 388828 - DNA, 439 bp, Homo sapiens
atgcaggaacatctgagtgcctttcacaccacacaggagctaacaggcgcccaaactgggccctcttttcctgactactctattttgctctctttcctcttctgggcctacccaattgtactgctgactcaccttaactagcgatttccttctggaatcccaaatgggaaacagaagagaagcccctcaggccttagccttcaatcagtctgaaacaccttccttccctgggatttactcctgggatcaagagaacttttcattacctagttttcctaactccactccccttcttctccctgccatccactagaacaggaagaggttcagacattctacttcctcaatgtcctacccttgctccatcctgggacagcaagctcagtggtctagtcatcacaggtgaaaaaatatgtctccttatactataaaataaact

SEQ ID NO: 388829 - DNA, 665 bp, Homo sapiens
cttccatctcctcaaggacaatagtggtcctagccatccctccaatcccattactcacacgccccagccacactggcttttgttctgctcctggaattcaccagtctcttgcttgccttatggctttgctctttcctgcctggaacattcttctctcagtttccctcacatgtcatttcttcagaggggcctccctggatccatttaaactaaggcccctttattttctctagtggaatagaaatcaattattttatctcatagttgtcatctccccttgtaagtacaaatttagtggtgtgttctctcgtttaatgtctttctacctcctagagtgtaaccttcacgaaggcagtggaaatgtctgttaatcgctgtatacccagagctgagcacatcacctgttagtgtgacacacaatggatatttcttgagtattgaataaatgagggagatgttgagaggaaattctcctgctactgatcctgtcataacaagagagttcatctgggtgtgtcaagttcctaggaaagaatcattataactgatgtgtttacagattgtgttgacagttttcaaatgtgcccaaagtttccaaccagtctgagagagggtcctcctgtgctgagtccagcagaatgacccagctgtgaaatgtggtatgg

SEQ ID NO: 388830 - DNA, 2903 bp, Homo sapiens
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacattctaggctagtttctggtcttatcattgagttacagcttagtgatgattttaagac

SEQ ID NO: 388831 - DNA, 919 bp, Homo sapiens
ctgtaatcccagttacttgggaggctgaggcaggagaattgtttgaacccaggagatggaggttgtaatgagacaagatcgcaccattgcactctagcctgagtgacagagcaagactccatctcaaaataataaataatatgtatattaatattgatagagaagagagagaatacctccttcaccatctttataatgatgcctacatatgtataatatatactcacccatgtatgtatacatatatagctatgagtttaatttatctccattctctccttcacctttctttgccttttctgtctgtcgtgtttccatagcaacttggcctcttcctgcccttgcaaccacagaaccagctagtgagtacagggctgagttgctctcggccagacctctgatcgcttgttgtagagccgacttctagattacagcgctgcctgttgttttcccttttattaaaagcaacagttgtgaatgcatgaaggctcctagcctggtgtggtttcctaagcatgccgtctgcttggccaagagagcaaaccaagcatcagcaaaagaacggggttgattattggaagaatactccgtgcatgaggaggcttttccaaatcgactctctagttaaaaatagccaaggattaggcaaaccctgaggacacaaaagaacagcatctccttcccggctttcgctttgctgtccctccttctgaaatacacacgctcatgcgcgtgttaatttagcagtagcaaaaagactgagagcgagggaaggaataggagaaaatggctgcttgaggaaagggagagggtgatgccgagaaggaaggagccgctgcttcctgacagcatgcccggctttgtctccgcgtacgcagagcacaggggaaggagagagctccttcctgctgtctccttt

SEQ ID NO: 388832 - DNA, 455 bp, Homo sapiens
actgtcagccctcaaaaatccagtatctccaacaaactgggtgtcacaaggctttctagtgaagtgttccacacctgtttgttgtcatctctcattaatgtgtggcatctcctgggatgcatctttcaaccaaccagcatcccagatttataggtcaaagcagaggatcagagaactcatcccagggaggaatggcacttgcagaaatgggcagccatgactttgcttgactcttctgtcttcttgctagagttgttttttagcttccagacatgaaatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaaaaaacca

SEQ ID NO: 388833 - DNA, 5863 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaatcatactggggtttattt

SEQ ID NO: 388834 - DNA, 5853 bp, Homo sapiens
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaatcatactggggtttattt

SEQ ID NO: 388835 - DNA, 5964 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaatcatactggggtttattt

SEQ ID NO: 388836 - DNA, 4925 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaatcatactggggtttattt

SEQ ID NO: 388837 - DNA, 4742 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgccccactggtcagcaaccatccctgggccgtattggggtgctgctccccccctgggcctgtccttgggcttataccgcggttggccgtcacactcagagcccggggtgaccggggttaggtccgttaggtgcgtgaaaaagggcggtttctgcgctcccttggctcggatgcgcgcggggttggctgcctatttttctcgggg

SEQ ID NO: 388838 - DNA, 2158 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgtctgcacgagtcacaccggagcctggggcaagcagtgattgaatacaaaccaccagacctcccgcctgcccatcatcaatgtg

SEQ ID NO: 388839 - DNA, 530 bp, Homo sapiens
cacgctagacactagaagacaatacacttgctggctgtatctaagaggcttcaccttagtgaaaggtaacactctcctaatcaaactcttgtattttagcgtggaggcttctgttctctcactttaatttcatttgctcgctgatccctagcccccaaattaaccctgctgtgctgcttctggcattgctgagcttctgaactggccttatggtattgatactgcactgaaccctctctaacctttgtcaatttaatttactaagttgaattaacctttgattctgtgttttctatagttgacctaattttttttctttttatctatttttttctctgtttctgtctctaccttccctttccttctgtccccctccccttcctgtgtctgtcgtcacacttgtcaccttggacgtcactgggacatccccactgccacatttgtttttaaacaaccacattatctctggggacccattgcttgacacctgcagcaaccttgggaggcaattctgcatcctacacctttgt

SEQ ID NO: 388840 - DNA, 443 bp, Homo sapiens
  misc_feature (393)..(393): n is a, c, g, or t
  misc_feature (434)..(434): n is a, c, g, or t
gctcggaggagagcgctcggtacctgaccagatagtgtctgatgggggagccgccgtcatcctgcttgatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggctcccgtctngcagtgaccacgtcatgcttgaagtccctggactggattgntgagtagaa

SEQ ID NO: 388841 - DNA, 5833 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaatcatactggggtttattt

SEQ ID NO: 388842 - DNA, 3675 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggattcattccccaacggcctttggcttttttaaggccaaccaagggaacaaaaacttttttacccaaataaaaccaatttggaattttcgg

SEQ ID NO: 388843 - DNA, 4773 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaaaaaacca

SEQ ID NO: 388844 - DNA, 5042 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccccctcctccaccggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcagaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaaaaaacca

SEQ ID NO: 388845 - DNA, 552 bp, Homo sapiens
gaattcgaggatccgggtaccatggcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggcctacttcacaaagcgccttcccccaca

SEQ ID NO: 388846 - DNA, 403 bp, Homo sapiens
aggtgtgctgcatcagttgtggttctgaattggctttggggtgaatacaaaagcatccctctgacattatattagtttgttcgcacactgctaaagacattacccaagactgggtaatttacgaaggaaagaggtttgactcacagttccacatggctggggaggcctcaggaaacttacttataattatggcgggaggggaagcaggcaccttcttcacaaggcagcaggagatggaaatgcaagcagggaagtgccagatgcttataaagccatcagatctcatgagaactcactatcacaagaacatcatgggggaaaccgcccccatgatccaatcccttccctccctcgatgtaaggcttacaggtccctccctggacacatggggattacaattcga

SEQ ID NO: 388847 - DNA, 223 bp, Homo sapiens
gggtctttttttttttaccttgggaacactgaatcaacaagatgtggtgcacctgcattttgaatgtgacccatcgcataaggtcaggtgaattttccacttgggtcacactagtgttggtaacgtttcatatttgggagcatttcgggctttgcatttttggaatggggatgctcaaagatgacattcttgtttgttttttttaggtgtggtaatgatatcg

SEQ ID NO: 388848 - DNA, 2482 bp, Homo sapiens
  misc_feature (978)..(978): n is a, c, g, or t
  misc_feature (993)..(993): n is a, c, g, or t
gactgcactgctgtgggaaacgctgtcctgaatggtgctgcagctcccacccaccttgtgcacccatctaccatcaggaagctctccatgtgcaaactggaatttagccagctggaatttattcctgtccctctgggaagctgtgtttgcttcttctggcctcccattctcttaaatgagatcagcagagtaggaaagggtgagaaggcattgcctatcacatgaagtgatggggccagagaccctaaggacccttccttctacgaatggttggtcaccttttgaggactgcaaagacttaggcatgtcataggcagactaaaggaagaatacacagttcctcttggactgctacatcttttgtaagcccttttccaggactaaactaagttcaattaagttctttaaaacagtaaattccgggatcagccttcgggccctcttctctgaccaattttatagcgtaccctcgttttttggtgtgctgcagtggtcatgatttttgcttgagaagtctgcaaacatagacacttctcttgaggttccatgtttatggatgatgttgtgttaatcctagccaattctgtgctattgggaattctccaatcatgaacactggggtggggaggaagacacaaatgccatgtgaggaaaggaaaatgcagtcgtctttttggaggatggctttttaaatacacccttcttagcaggctgcttaaaatacacaggagaaaaggctctgctgggcaatgaaccagatgaaaagctgcccacccagatcactgttgcaggttgactatttggcttagcaactcatgggatttcagaggcccttgaagtttttggtgagtatagtgtgggggagagcaggctttttaaaaggggggggggcatcctcctctgtgtagcactgtttaagatcactgtaagttgaccagtttttgtttacttttagcttctcttagaggcactcctctnttgcttggaagtctnttatggggtataaggtgctacatggtagctgtttccccccttgctaaaatgacatggatgaattttaaaaatgaaatgagaccttctagaggcaaccattatctgcagtgcctggctggtcgactttagagtaggaagctcttgaatccaggagcaaattagttaaaaccccaagttccagtggtaactggtataagcaaaatggaaactgaggggctatggaggaatctctgtttgttggaacgtaatgaaaccatggaggaaataccagatttaagggctaagaagctggcccgatgggtaaatcagtgttgggagtcaggttcttggcccttcaaggacttgctatgcaacctcaggcaaattcctctcagtctttgtgctttctctttcttgtctcatctgacagttatgaatataacgtaaaataaagatcaactatcattgataacactgttcctgcaaatgaatactgtgaaacatcagggaaagaggaaaaaattaagccacaagaaaaccatttggcagtgtccttaaactttttttgggggggggcagtgtaaaacatgaaacctagtaagataattgggccattagatcttcatcattaaactcactttgcaaggaagtgtaagaaatctgtaaaacaaaagacattcctatctcagaagctcaaactggtgatttccaactgcctctttacaggagggggctcaaggcttctgatgagcaaaggctgtgtgttgtatgacagtccactctctgcacctacacttccacgtgccacgactgacaacttggttataaccatgaaaataatgaccatacctccccagccagcagggtctggaaggcctgaggaggctcatttttaaacactgcactttaaaaattggaaaccgtgagatgaagaaaaattcaattaagcggaaatgagttttgttttattgcctgctgctgaagggctctgggcatgctgaaagctaaatgaaaagcacatcactggctctctctttcttggattggtcaattggccctttttgcagtagttgctccaactgttctaaacagtgagtgactggagccaaaaagagagagctcagcaaagccatcccatccacactctgcttggtaggaccacactaaaagcacagtttcatgctgctagctctggtaaggagacagctgcaggtttgggaggtgcaccaagcattcctttgcttagggaggcagagcacaggtgaacagaggaaggacacccccactctcatctattgcccaccgagaggcaagaatcacaccaactttcccacttgaggactgtgttcggccaaacaagcaggttcagggctgcgggattccagaagttgctctgagcttgcaatcagacctcaaagccccagatcccctcagctctggatcgttgccctcatccttcacaatgtaaattttgtacagttaaagagaaatgaagtctcgtttcctgggg

SEQ ID NO: 388849 - DNA, 2643 bp, Homo sapiens
  misc_feature (978)..(978): n is a, c, g, or t
  misc_feature (993)..(993): n is a, c, g, or t
gactgcactgctgtgggaaacgctgtcctgaatggtgctgcagctcccacccaccttgtgcacccatctaccatcaggaagctctccatgtgcaaactggaatttagccagctggaatttattcctgtccctctgggaagctgtgtttgcttcttctggcctcccattctcttaaatgagatcagcagagtaggaaagggtgagaaggcattgcctatcacatgaagtgatggggccagagaccctaaggacccttccttctacgaatggttggtcaccttttgaggactgcaaagacttaggcatgtcataggcagactaaaggaagaatacacagttcctcttggactgctacatcttttgtaagcccttttccaggactaaactaagttcaattaagttctttaaaacagtaaattccgggatcagccttcgggccctcttctctgaccaattttatagcgtaccctcgttttttggtgtgctgcagtggtcatgatttttgcttgagaagtctgcaaacatagacacttctcttgaggttccatgtttatggatgatgttgtgttaatcctagccaattctgtgctattgggaattctccaatcatgaacactggggtggggaggaagacacaaatgccatgtgaggaaaggaaaatgcagtcgtctttttggaggatggctttttaaatacacccttcttagcaggctgcttaaaatacacaggagaaaaggctctgctgggcaatgaaccagatgaaaagctgcccacccagatcactgttgcaggttgactatttggcttagcaactcatgggatttcagaggcccttgaagtttttggtgagtatagtgtgggggagagcaggctttttaaaaggggggggggcatcctcctctgtgtagcactgtttaagatcactgtaagttgaccagtttttgtttacttttagcttctcttagaggcactcctctnttgcttggaagtctnttatggggtataaggtgctacatggtagctgtttccccccttgctaaaatgacatggatgaattttaaaaatgaaatgagaccttctagaggcaaccattatctgcagtgcctggctggtcgactttagagtaggaagctcttgaatccaggagcaaattagttaaaaccccaagttccagtggtaactggtataagcaaaatggaaactgaggggctatggaggaatctctgtttgttggaacgtaatgaaaccatggaggaaataccagatttaagggctaagaagctggcccgatgggtaaatcagtgttgggagtcaggttcttggcccttcaaggacttgctatgcaacctcaggcaaattcctctcagtctttgtgctttctctttcttgtctcatctgacagttatgaatataacgtaaaataaagatcaactatcattgataacactgttcctgcaaatgaatactgtgaaacatcagggaaagaggaaaaaattaagccacaagaaaaccatttggcagtgtccttaaactttttttgggggggggcagtgtaaaacatgaaacctagtaagataattgggccattagatcttcatcattaaactcactttgcaaggaagtgtaagaaatctgtaaaacaaaagacattcctatctcagaagctcaaactggtgatttccaactgcctctttacaggagggggctcaaggcttctgatgagcaaaggctgtgtgttgtatgacagtccactctctgcacctacacttccacgtgccacgactgacaacttggttataaccatgaaaataatgaccatacctccccagccagcagggtctggaaggcctgaggaggctcatttttaaacactgcactttaaaaattggaaaccgtgagatgaagaaaaattcaattaagcggaaatgagttttgttttattgcctgctgctgaagggctctgggcatgctgaaagctaaatgaaaagcacatcactggctctctctttcttggattggtcaattggccctttttgcagtagttgctccaactgttctaaacagtgagtgactggagccaaaaagagagagctcagcaaagccatcccatccacactctgcttggtaggaccacactaaaagcacagtttcatgctgctagctctggtaaggagacagctgcaggtttgggaggtgcaccaagcattcctttgcttagggaggcagagcacaggtgaacagaggaaggacacccccactctcatctattgcccaccgagaggcaagaatcacaccaactttcccacttgaggactgtgttcggccaaacaagcaggttcagggctgcgggattccagaagttgctctgagcttgcaatcagacctcaaagccccagatcccctcagctctggatcgttgccctcatccttcacaatgtaaattttgtacagttaaagagaaatgaagtctcgtttcctggggaaaaaaaagaaaaaaagaaaaaaaaaagacccacccatccttatttattgccatatgactttggaaaacagaagctggtgcgtttgtttgtatatgcctcctgtgtgttggcatgagatgtgtacggtaaaattatgtaaaataaatatggaaattcttta

SEQ ID NO: 388850 - DNA, 939 bp, Homo sapiens
tcggtaccgggagtggagagagaaagagagacggagaagagagaaggagagagagaggagaggaagatgggcagggatgtatcccattactgatgtttctctgtaaactgtcttttctatttcacattgtttcagaatgtaacacatagacaactactaaaattacaagcatttaagatgcaactcaatgaatgatcacaaaatgaatgcacccatacaactatcactcaggccaagaaacaggcccccagcacagtggttctaacctgcattctatttcatctccagcaaaatgtctgtttctgtcattcgcccatgtttcttattgcttgatttttgctgacttctcaagagcaccccagcatttcagatgccgttctctctccactcccgggagtggagagagaaagatacagaactgtattttatttcattctgagtcaaggttttcagaaaacaaatatttcatttggagtgttcatttcctgaatactagacagataacttctgaactagcttgagaaattaaaatttgattctagggtagtaaactctttgcctcttggagccaagcaggtttaaggtacatgtacatacattggattcatggtagacagcatacccaccctaaagagggcagctctatttaaagggaatagtcattgttcatttctggctggttccgttgttttgttctgtcaatctgaatgttcacagggaacttgaactggtcaggtccaaaactaatcttaatctcagttgcctccaacccttcataaacagaccagctatctgtattgctcctctttcctctcccctccctctcctttcttctttctccccatccctcctttttccttcccccttcatttttgtcttcccttcctccaccttctctttcctttttttttttttttaaaaaaaaaaaaaagagagact

SEQ ID NO: 388851 - DNA, 363 bp, Homo sapiens
tgtgccctaggacacgctgttcctgcagcttggaaggcctctgtcctccatccgcgcgccctcactctcttgctacgaactcccattcatccttcaaaacccagcctgagtgtcccctcccccgggtcaccccctttgacctgtcaatcccctccctccgggtccccagcaagcttttcggtttggcttctccgcactctcatgaccgattgccctacatcttggcgctcccagactcgggccttctccagcaccggagtcgtctggtttgctcgctttacactccaagcacctagtaccgagcctgactgggtgccagagggcgcgcctaggctcaggctggctccacccgccccgtgcctc

SEQ ID NO: 388852 - DNA, 351 bp, Homo sapiens
gtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctct

SEQ ID NO: 388853 - DNA, 393 bp, Homo sapiens
gtgcaagccaatactttgtgatgttacattgattactatatttcttcaattctagatgtatattttcccacatattaacatgtctaaaattgatatgtatttcacagtcatcattggctaggaataggaagttgtcacagccaggtcatgcatctcatgacttaagaattttgacagtccaggccagttgtgcagtgcctcaaacctgtaatcccagcactttggaggccgaggcagacagatcacttgaggtcaggagttcaataccagcctggtcaatatgatgaaaccctgtctctactaaaaatacaaaaattagccaagcatggtggtgcactcctgtaatcccagccactcgggaggctaaggcacgagaattgcttgaacctggga

SEQ ID NO: 388854 - DNA, 365 bp, Homo sapiens
gggaggatcgcttgaacccagaacgcaatggttacagtggattgcgccactgtgctccagcctgggcaacagagcaagactcagtctcaaaaacaaaaacaaaacaaaacaaaaaagatgagatttatagaagcctgaggctattccatgagcagaattttgaggccacacctgggttgagcaactaatccctgagcttaggaacagaaagatgaacaagggagccctaggagtcaacagatgccccaaaccacaagtcactaaaggagggaaaggaaggctaagcactttctcaaactgtggcgctcccaagcatggttttaggcagtacaaagtgttactttagccgttacgggattatacta

SEQ ID NO: 388855 - DNA, 452 bp, Homo sapiens
agcatatattggatttgttgaacaggaagtcatttgggacctttcagaagtgtagtatcctgaaacaccaagcaaattcagaccttcatgctgaggtgaatttgtaaagggtcattgggcgtaccctttgggagaactgatacggccttcagacctttgaccaaaacagataaaataaacacagaaagacataccaagaatgacttaaagggaggaagcaaaggagtccaataatgtattacatttcaacataaaggagaaggatgggcctcctctcactggtgtgaaagagggttcttagagatgattgatacgcataccgtaagtatgttccctggaccagcaacatcagcattactcagaagcttgttagaccctacctcagatctactggatcagaatttgctttccaacaagacccacaggtaattcttttgtacattacattttaa

SEQ ID NO: 388856 - DNA, 207 bp, Homo sapiens
caagataggtggaataatcaaatctatattgttgcaagacttatattttatataaagtggtatgattgacataagttaatcattaattgactgcagagctaaaaagcacagagaagagttaaaatggaatattggaaatatctgactaacccaaaataaggcaggaaaagagaaacaaagaaacagatgagaggaacagaaataaac

SEQ ID NO: 388857 - DNA, 689 bp, Homo sapiens
gtgtaagaatgcttgtttttccacaccctcaacaacactatgccttgctgcattattaatgtgtggaaatagccagtgattttaagtattatttgccttagagattatagtagtagaactcagatttatagtgtgacatgctgttctggaagagcaaagttattaccttaaatgacccagagtctcactctgcctttgcacctgttttagttactttcaaagttaacttggctggaaacttgactgtatatcaagttagcagttactgtaatagtatagtttgtcaggaagtgtatgtcattctctttgacataatggatggtattttgtgaggaaaaataacagtgattctaatgatggagtcatttctcattatggtaactaatggtcatcttaacagttggtgaaaaaagaggtggcagtttttatagttaacatattagtagcattctatttgggattttcctcttttcctgatttgtaattcctttgccatgtgttgtgaatactgagttccaaattaaatttttattcagctggaattttggtttttttttttgatgaatggtatgcagtatgactaaagcctaggtttttttgcccccttgagcagttagccacttccaacattatttgttgaaataaaccattcttcctaacttgagataccatatttatctttatcatat

SEQ ID NO: 388858 - DNA, 981 bp, Homo sapiens
cccaagaggcagagctagattgcaatgagctatgaccactccattgtactccagcctgggcaacagagtgagaccctgtctcaaaaaaaaaaaaaggccgcctgggttcaagtcgatcaccttttgctgtgtgaccttgggtgagttactcagtttctctgtgcctcagtgccaacattaatatgaagataggatttacttcatagggtggttgtgaggaagaaaggtgatgtgggtgaagttcttggcacagtgcctggaagtgagctcttaccaactggcactgtcatcagaattgtggcttccatggagtttgagattctgccttagtccccttgcatcttggctcggcacatgcactttctgatcccctggcccattcattcattccttggtgtgtgtagtccctcagcagcctcctccagctctggggcttcaagtcacatgtctggtcagaaactctccagagctttgtgacctcccccgggaatacttggtgcctccccgtgggtggctgaggcatctgagtccaaagcaggccccacagaactgccctgtgttctctgcctgagtgtgacctcacatctggggacgccccgtccacaggttctcagtgcagatcccagggtcaccctggatttccttctttccacgattcccagagtccaacacgtcgtcttgggcaacagagtgagaccctgtctcaaaaaaaaaaaaagggcccctgggttccaggtcgatcacctttggctgtgtgccctggggttgagtactcagttcctctgtgcctcagtgccacctttattttgaagatgggattaactccataggggggttgtgaggaagaatggtgatgtgggtgaatttctgggcacagtgccgggaagtgagctctaaccatgtggcatggtcatcagaattgtggcttcgataaacaccggtgtgtatcgatgccaccatgattgccagagactccacagt

SEQ ID NO: 388859 - DNA, 343 bp, Homo sapiens
atatcgccagtccttacagtgctgcaaaggaggcattatgaccttccatttgaaagctgaggaagtggaagctcagagatgtttagtaacctattcaagatcaccatgctcttttttctataccaggtcagcctgagaggttgagtgagctctgcaatgctcctggtttactcaggaggattagggcaataggcagaccttttcttgtttttcttactgtctttccttttgatcaaaatgtccatctcaaaatgtttaaatcatctccagagcaagttcgagttctcctgtgtctgcttttgatgacctttctgtctcttcctttgctaccacactgccttct

SEQ ID NO: 388860 - DNA, 2058 bp, Homo sapiens
aaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatgttcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaaaaaaaaaaa

SEQ ID NO: 388861 - DNA, 434 bp, Homo sapiens
ggggttttatacctattttactttctagttagtcactgtagaaaagtcatatagctcaaaagttttttgtctacattacttgtaaagatgtagagtttcattttatctagttggtaatcaaagggatttatatgacgtgtccttccagttcccttccagattttaagaaaccagatttgctggtgatatattattcggatgacctttaggatgtgagctgatacataaaattaagcaaagggcaaaagctttgcccttccatccccctcaaacagtaaccattaatgagactgaaatgcagatatcaaagaaataaaagttacagttaagtgaaaccatgatatataatttataataaataatttggggccaggtgcggtgactcatgcctgtaatagcagcactttgggaggccaaggcaggcggatcacctg

SEQ ID NO: 388862 - DNA, 230 bp, Homo sapiens
ctctgtggtagagtctctttgtatccaaattcccactaagctcagtagcccatctgcctaaacaatattgctgggtgctccaccccctcaaaacatgtttgtagcaagttatcttcaaaattgaggcccaagggttgggagaaaatggggagtgaatactaatgggtatgggatttcttttgggggtgatgaaaatgttttgggtttttttttgttttgttttgtttttg

SEQ ID NO: 388863 - DNA, 453 bp, Homo sapiens
aaatactggatcaggccacagaaaggtaatctaggatcttgttcaaagtgtggtccatagcaacatcagtttcacttgggagttactgagaaaggcagaatctctgcagacctactgaacgaggatctgcattgtaaaccatttatcaaggctgggcatggtggctcacacatgtaatcccagcattttgggagcctgaggcaagaggatacttgagaccaggatttcgagaccagcctgggctacacggtgagaccccatctctacaacaaattaaaaaattagccaggcatgctggctcatgcctgtggtgccagctaggaggatcccttgagcctaggaggttgtggtaccaggtaggaggatcccttaagcccaggagattgaggctgcagtgagcccacattgcatcactgcactccagtctgggtgacagagcaagaccctgtctca

SEQ ID NO: 388864 - DNA, 708 bp, Homo sapiens
cctgcctgcctcaagcgctaacatggaatggtcttgcacagagttagagccaagcttccaccagatggcaggcagaaaaaggtcagggcatgtcccaccaccctgctggatttagggcagggagaaatctgtgctgcttgactttaatcaagacatattcagcattttccatgtgttgacactttgcagatagtgatgtcactgtcatgagtaggtctgcctggggaaaacacactttcctaaatgctgacttcttttttttttaaaccaccactgcataaaaaaatacagctgatctagccatatttccacactgaatggtgtgctttccttctgtatactgcaaagtctagacaggcatgcagcaaagacttcagaacgtaattacatgaaagtgaaggatgtaaacagttgtctactcacaagtggttacttgcaagtggtgagatgaaagcccatctccagtgagctgtttaggaatattcctgacagcttcgaaaagcaaagattcttctaaacgatacagacaatctgagaaagcagatttcttggccagcccactaggccaatacagatttgaccctcaaatggcaagagatcgctgactcacagaatgacgaatcaacgtgtgtgtgtgtgtgtgtgtgtgtgtgtgtgtgtgtgtattttaggttccatgtttatttggtgctccacataatcacgaat

SEQ ID NO: 388865 - DNA, 1438 bp, Homo sapiens
  misc_feature (1437)..(1437): n is a, c, g, or t
agcggagataagattcagaggttgaggatggggtgtcctggtggactgaaggtagcctactagctgtacatgggtgacaacttgaaacttcagaaccctgaagtttaaaaaattctaaaggtgcctgtcatctcagagagtgacgtaagtgttctttctttatttgggggaagtccaggagaacatattacagacatgtttaatccacatgcattagatgttcctgctgtaatttttgacaatggttcaggactctgcaaagcaggcctgtctggagagattggaccccgccatgtcatcagctccgtcttgggacattgtaaattcaatgtgcctttagcaagacttaatcagaagtacttcgtggggcaagaagccctgtacaagtatgaggccctacatttgcactaccccattgagcgtggactggtaacaggatgggatgacatggagaaactctggaaacatctctttgagcgggagcttggagtaaaacccagccaacagcctgtacttatgaccgagccctctttgaatcctagggaaattcgagaaaagctagcagaaatgatgtttgagaccttcagtgtgcctggtttctacctgtctaatcatgcggtggcagcgctctatgcctctgcctgtgtcacaggcctggtggtggacagtggagatggggtcacttgcactgtccccatctttgagggttactccctgcctcacgcagtcaccaaactctgtatggcagggagggacatcacagagcacctcacccggctcctctttgctagcgggtttaacttcccttgcatactcaacaaggccgtggtaaataacatcaaagagaagttgtgctacatcgccttggagccagagaaagagctacgcaagagccggggagaggtcctgggagcatacagactgccagatggacatgtcatccactttggggatgagctgtaccaagtgcccgaggttctttttgcacctgaccagctgggcatccacagcccaggactctcaaaaatggtctccagcagcatcatgaagtgtgacactgacatccagaataaactttatgcagacattgtactctccgggggcaccactctcctccctgggctggaggaaaggctcatgaaggaagtggaacagctggcttccaaaggtactcccatcaagatcacagcttctcctgatagatgcttctctgcatggattggtgcatccatcatgacctctatgagcagtttcaagcagatgtgggtcacctcggcagacttcaaggagtatgggacatctgtggttcaaagaaggtgcttttaaagatccttgagcagaggagacatcttgaagtgtcagattacaggagtaccagtgggagatggcattttcttctgggcttcagcatgatgttcaataaaagttttgccattnc

SEQ ID NO: 388866 - DNA, 618 bp, Homo sapiens
caagatggggtgaggtcttgctgtgttgcccaggctggagtgcagtggcctgatcgtaacttactgcagcctttgcatcctgggctcaacctgtctcagcctccccaggagctggaactataggcgcatcccaccatgcccagctaattttttattttttgtagagatggggtcttgctgtgttgtccaggcaggtctcaaactcctgggctcaagcactcctcccacctggccttcccaaagtgctgggattacaggtgtgagctaccatgcccggcatatcttcagatcattcatatctggcacagacagttgacctttttttagtcaacagagctggtttgcacaggagattgtaagtgggtctatagagatggaaagttacaggttccatctagtagaggctactagtttttgaatagagggagagaaatctattccaaaggaattgcttcctcaatccccactggccactgcttgtgcggtgccaggcaagagggtggactacaggggcaggcagtccagctagcggcacagccattcagtgagtcaggagtctttgtgcaaggaaggctgaggtgatgacagagctaacagcaaactcagacaatctgaaaa

SEQ ID NO: 388867 - DNA, 357 bp, Homo sapiens
tgggcatggcagagcaaggggtggtgagaaacaccgtgcagacactcattcgtgggcaagagtcagagcctgtgaaacactagctaaaatttagcgcgtctcaaacttcactgcaattggagccccggggaagcgcctagaaattacctttgccttgggggtggttcctggaaatctgtagcggtaaaaggtctgcacttggtgtggcagccatctaagaactggctttaggaaccagagctctcctcacagtgtggtcctcacatctgcagctctggggagtaggcgctgtgggtgttcacttcccctttcctaggccaggacagctgtgagtgaccatgtgaatggctcacagct

SEQ ID NO: 388868 - DNA, 287 bp, Homo sapiens
gtggaggatcaagatttcccttatggatgtgtgatagttgagttgtctattagtcttccaattggtgataattggtagataattagatatgagtctaaattttagaggagaggtaggagctggaaatatgtgttcatggaccatgcacatatacatagaatttaatgccattgggcttcatgagatcacagaagcatgagtgcacctagaaaaacggttgagaactgagacctgggatactcccttgttaaaaggtaaatgttccttctacattttgaatttataga

SEQ ID NO: 388869 - DNA, 207 bp, Homo sapiens
aaagtctgttactttcctatgcaatagtaataaacatttagattttgaaagtcaaaacatagtaccatttaccttagcaccaaaaaccttaagcataaagctaacaaaacatgcacaggaagaaaactacaaaaaactctgatgagagatatcaaagaaaatctaaataaaaggaaacatttaaaaagtatatttttattgtgaaga

SEQ ID NO: 388870 - DNA, 241 bp, Homo sapiens
gatacattattattaactaaagtacatagtttacattagggctcaatctgtgtattgtacattttacaggttttcacaaatgtgtgacatgtatctgtcattaaagtatcttacagaatagtttcgctggcctaaaattccttgtgtgacacctaattatttctttcacctatgcctgagctgttgaaagacaatactgttattgtctctatggtttttcctttttcaaaatgaaatattt

SEQ ID NO: 388871 - DNA, 790 bp, Homo sapiens
catttttatcagttttggaaccacagctcctccatggccaaatttctctttatgtctcaggtttcagagcatggcctaatatttcccgtacagacaggccgctccgctgcccttctgattcagctgaccactgtgcactgtagcgacgtgcaaggggtaggagtggacacattccagctcgctggggtttggaacggcacctctcattcccagagaagggattctctgtggaggctgagttggcagtgctcaagcttgccttgcggttggcacgtaggccatcagcaatcatctgagtatcaacctgccaagctgaggccgtcctggggcacagagatttattgctaacagaggaaagaaaagaaaccatttccttaattctgctttgcaggccactctcatggaaaggaactcccctgctgccctgatcagttcaatatctaactcatcatgcctgtgttcttccccagcagctcaggccggtctgctaccaggaacaggtgccaaatcagagtgtggaattttcccagcaggccccagggtgtgttgctgccaaggcaactgtggtagggttggggaataactagcgaaccacaaatccagaaaaggaagaggaggcctccttttcggcttgggccaactcaggtacaggctgtcccttgaggaaagctgtgggacacccccaacaccaagtgccaaggccagacaaggccagggcaggccaggctggaccctacgggcagcttgccagacctaggttaaccagaccaggtaaagacaactgagaatg

SEQ ID NO: 388872 - DNA, 382 bp, Homo sapiens
tcctactttttttattttgttgtaagccatctaaaattctcaatgggatgaaactgggtataaatgaatacatgcatacaggaattatagtagcatattccttttcttttttctttttttttttttttgagacagagtcttgctctgtagcccaggctggagtgcagtggtgcgatctcggctcactatagcctccacctcccaggttcaagcaattctcgtgcctcaacctcccgagtaattgggactacaggtgcatgccaccacacctggctaatttttgtattttttagtagagatggggtttcaccatgttggccaggctgatctcaaactcctgacctcaaagtgatctgcctgccttggtttcccaaagtgctgg

SEQ ID NO: 388873 - DNA, 324 bp, Homo sapiens
aattttttgttctgatgcttaccaagcctttagagaccctcaggtaacacaaagtattattaagttagaaacaattcaagtaagtattttctgaagcaaaagagaaactagacacagggcagactctcccgctgaaggtttcctgaacaattaccttgattctgcttaatgtcatctaaacccagtgctcagggcacatgcaataatcatgatagattcccttgttcggaggtagacatggaaagccttagtaggcagacttctcagatggtctccactgatacccatctcctggcatttgtgccctggtggaatttctttccc

SEQ ID NO: 388874 - DNA, 181 bp, Homo sapiens
tgtggggttggggcaggtccccctcccggagagctttgtcttccacaaacacaaaacctggaaatggttgaggaagatggaacctcctaacgaccattgttcgggggcaggagtgggtgcccggaagcatgggtggtagtaggggacccacagctgcagctggcctgctgggcttctgttc

SEQ ID NO: 388875 - DNA, 306 bp, Homo sapiens
actgcactccagcctgggcaacatagtgagaccctgtctcaaaaagaaaagtgataaattatgtttaaaaaatagtttaagccaggcgcagtggctcatgcctataatcctagcactttgggaggctgaggcgggtagatcatgaggtcaggagttcaagaccagcctggccaacatggtgaaaccccgtctctactaaaaatacaaaaactagccaggcgtgatggcgggcacctgtagtccagctactcgggaggctggggcagagaattgcttgaacccaggaggcggaggttgcagtgatct

SEQ ID NO: 388876 - DNA, 522 bp, Homo sapiens
ggacatggagctacctgaaaatggagatctacagacttagggaccactcatggaggagaggagtcaagaggagcacccagccaccgtgcctggctgaacacacattactcagatggggacccaggaggaggaggagcaggttaggttggagtgccaggagctgcggggcaggtgtccagaaggcagatggatctatggagccagggttcagaagaatggcctaaatgtctttaatattctcaggattctacatgggagagggtggggactggggagtgagcctgcccaaacccatccccaatccaagactcgagggagaggccagaccatacacaccatgtccaggcacgttcctggtgttaccagaattagggggcatgggcctgcagttttggggaaggccctgggaccagttatggcgtgagggaggggggcaggaagcatgaggcctactgtgcctgggtcctcatgccccaaactgagctcctccaggcctgctctgccggcacggtcagaagatta

SEQ ID NO: 388877 - DNA, 612 bp, Homo sapiens
gcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatg

SEQ ID NO: 388878 - DNA, 334 bp, Homo sapiens
ggaggagctgagagcagttgttgatggccgtgaaaaaacggagccccacactgcaagaggctgagcagcatcgttttctccagggtgagcagaccgctcctgggtgagatgggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagctgggcatggctggtcctggggccctgggacacagatgattagctc

SEQ ID NO: 388879 - DNA, 345 bp, Homo sapiens
catacatcagctaacagaacaaaaagttttacagtgctttctcatacaatgtctagaatttacagataacaccagtagttttggtcaggggttaataatattattattattttagccaccagggccaggtggtggtgccaaggtcgtctagctatttatcttacttctgtttctttccaactttttgctttctcccttttctcctgtcttataaactagggaaaaggggaggttggagagaaactaagaaggccaacaggagaagtggtggcctcataccatactgtaacagtgctgagttagctgttatttttctgggacctagagaagttgaatagttaggaa

SEQ ID NO: 388880 - DNA, 513 bp, Homo sapiens
caggtccttgcttcattatcttatgagtatgtgttttactttaaatgtgctggttcatatggcctatttttaataaaattaagtcaatgagctaaaatcagatatttaaacaaatagttatactttatgaaatgagaaagacgatatcaaactatatattacaggggcttatttagagagagtaagatttacccagtgattaatttttagggctcagaagtaaattgtgtctgagtacggtggctcatgcctgtaatcccagcactttggggggggcagggtaggcgaatcgctcgagccctcaagtttgagaccagcctgggcaacatgacaaaaccccgtccctacaaaaaaaataaaaaaattagctggtgtggtggcataagcctgtagtcttagccactcgggaggttgaggtaggaggatcacttgagcctgggtgatcaaggctgcagtgagctgagatcgctccactgtactccagcctgggcaacagagtgagaccctgtctcc

SEQ ID NO: 388881 - DNA, 657 bp, Homo sapiens
atagatgaagaaaccaaggctcagtgcctaatctagctacataggtaattagtggcagaactatctaatgcagtgttcagggactgcacgttaactagtttcttatatatttttctgttgccttctaattggtgaaacaaagttttgtctgtagtttttgtttttgttgttttgttttgtttttgagatggagtctcactctgtcatccaggctggagtgcagtagtgcgatcttggcttactgcaacctccgcctcctgggttcaagcgattcttctgcctcagcctcccgagtaggtgggactacaggtgcacgccaccacacccagctaatttttgtatttttagtagagatgggggtttcaccatattggccaggctggtctcaaactcctgatgttaagtaatctgcctgctttggcctcccaaattgctggaattataggtgtgagccactgcgcccagccttttttttttttttttgagacagagtttcacccttgttgcccaggctggagtgcaatggtgtgatctcggctcaccgcaacctctgcctcctgggttcaagcgattctcctgcctcagccttccaagtagctgggattacaggcgtgtgccaccacatctggccaatttttgtattttcagtagagacgg

SEQ ID NO: 388882 - DNA, 787 bp, Homo sapiens
ggacctgcagggtaaacttgggtgcctccatctgggaaagctgatgatgtgttcatgcagtcgatgaccctcactgctttttcagccagggtttctctgccttctgcctggcagagaaaacacactgctatggggaaaatcacagggagggcgctgtgaccagcgcactcaggcaccaagtgtcggcatggctcactgtgctgggtgaaggcctccccgagcattaggtcctccacggggctgtgtcaaatgccctcccacattgtgtcaagtctgcccatggcccaccctccccacagtccaaaaccacacagccctggttctccagctgttctgctgctgtttctgtgctctccctgattaagagcattcagttcctgggctctccctttgagcaggaaatggtgaaagcatgtggctatggtatagcccacagggctgagattgctgtgttgcagtattgatgtaaaatttgttaagaaggaagtacccacagatcactgccatcaactccccagaagttgcactcaagctagtgagcagcccttgtgcttgtcacagttactgtaacaggtagtgtgtatttgcacctggcatcgtgcagcctgcacgtcaacacgttgttttgtgtaactagaacagcacatggaaccactatctctttctcttttttccttctttttcttttttttttttttattttaattttttgagacggagtttccctcttgtcacccaggctggagtgcaatggcgtgatctcggctcactgcaccctccacctccc

SEQ ID NO: 388883 - DNA, 994 bp, Homo sapiens
ccaggaaacactccgaccaactgccacgccctcctttgctccaaaatgacaagctcttttcatctgggagcaaaagctgaagtccccacatttgaactaaattagtttagtgtaaaagtagtacaagattatctcagacaattgtattttaatagtatttttttctagtgataaatgtaatatatgtctactatggtcatttggaaaattctgagacgtatagagcagaaaagaaattctccataaccctaacccacaaaaaataacttttgaaatgcttgtgtattttttaattcttttttaatgcatattgtaggacaacttactgaacatttggatttttagaaatatttttaataaaacgtgttgaagtacagcatacaaaaaagtgtacaaattacaaatacagttcagtaaactttcaaagattaacacaaacatgtccgggcaaccacaactcagctcaagaaattaactaatagtagcattcttcatccccctgttagttttgtctattctgacatttcacatgaaatgaattacttggtaaatattttatagtatttggtttatttccctttatattatatttgaattcatccgtgtcgttgcatgtaacaagtcttttttacaattttattctatgctgtatgaaattcagttatatgagtatacacaaaaaaaaaaaaaaaacgacacacatgacaaccacagtacagaccaacaaacacaaactacacagacggggggggcgcacccaataaattcctccagaagcccgacaatataagacgacctacccacactttcttgtatttctacaagaggacggcccaacaataaagagaccgtcagttataaaacgagagaacacccagccagcaattataaaagcactgtgtcggcgaggaaaaacactcgtagccacggagagaacttttagaaggagagacagcacacttatcgggaggggagcacacctgcgccaacccct

SEQ ID NO: 388884 - DNA, 313 bp, Homo sapiens
acctagcatgctgtgctagtttgacaggtactgtgtattaatcatagtcccaggttgtttgagttgactattattttagcattgaaaataaacatgatttattcctttctcacctacttttaatttctctgtatatccctttttcagttttgactaggaacatcatttatctcttattattagaaataatttcagcaatataaaattttaagggttttttcaatacattttatgacaggtatatatatctatatatatgatatatagattatatataggtgtatatatatcatatatgatatatatatatatt

SEQ ID NO: 388885 - DNA, 744 bp, Homo sapiens
tttttttttgagaactggacattatgaatactatgttgtggtaactctggtaacttaattattttgctcttcagggattgtcaaatcttggttgttgtggctcagagtcatttggtcatgattttttcccaactatttttattctctgttgtgcatggtcattgaaatctctgttctgttatctctgctgtcagccagttatctaataaaaattgtcttaaatgactgcttcctaaagggaggaaaaacacatactatttatttaaatccttgggaagccacttcagctgatgaggactgatgcaatgatagcccacttctgtgtctgcccctcagcattcaaaggcagaaatcagcaataaccctgatatttggacaaaaaggtgcttattgttcaccctggctgcaggaattcattacaagaacatgggcagcagttcccatggatccctgcaataatggggtatggaaaatagttattattgagtggaaaggctgaaattcaccaacattaaccaaaatttatcatcctctttatcaaactcttcccttgatgcttccagtgtttaactagactcgagaattccaaaatagttacttcagacagtttttgacagttcaatagttttctcagtgggaggaacagatttctgtagctttttagtctaccaacctctatgacatcattcttgcttgacttattgtttttattttattatttttttgagatagagtctcactctg

SEQ ID NO: 388886 - DNA, 732 bp, Homo sapiens
gtgaacatgaaggcagagatccaggtgatgcacctacaagccaaagtatgccaaagatgaccagcaaaccaccagaagccaggggagaggcatggaacataaggtttctcacagttgtcgaagaaaccaactctaacaacgtgatctagaacttctagtctccagatctatgagataataaatttctgttgtctaagccacccagtttgtggtactttgttgcagcaagcctagcaaactaatgcacacatattctatattttgaagaaaaaattcccagagaatcatttttaaaatggttaaattaagcaaaataaaacaaaccaaaaaaagagaagtcccaactacctgaaatatttaattgtcttaggaaactgacttaaaaatatctaatacaggccgggcgcggtggctcacgcctgtaatcccagcactttgggaggccgaggtgggtggatcacaaggtcaggagttcaagaccagcccggccaagatgatgaaatcctgtgtctactaaaaatacaaaaatttgctgggcatggtggcaggtgtctgtaatcccagctactcaggaggcagaggcagagatttgcttgaacccaggaggtggaggctgcagtgatccgagatcacaccactgcactccagcctgggggacagatcaagactccgtctcaaaaataaaaaaataaaaataaagaggaagaacgctatggaatttgactagaatta

SEQ ID NO: 388887 - DNA, 397 bp, Homo sapiens
actcactactggaggcccagggtaactacatcaacccctgatacagatctctgggcctgctcacagctacagctcaatgggggctcctttggcaatgacacccaacaatggagtaaaccagggacctggtgaacacgctcaaaagcccatgaacaggttgagaaacaaagccagttgcaccaccctcctcccaaccatggtcttccagaacaggaagcagaacccacccgctccgaacaaatctgatgacttcttaccattgtcgtcaccagaatctgactggaaggagctgagggactgaacttcagagttgctgcctttattactacctgcaaagcaggtcacttctcccgggtcatcaacccctttgtcttcatggacagtgaaagagaaagca

SEQ ID NO: 388888 - DNA, 374 bp, Homo sapiens
ccccaagccatccgtgatttggccccatcctgctattcactctcatctcctatctcacacaatactccattacatagatgtgttccagttacacgggaacacttgtcattgacctgcatccccaccttcagggttgggcacatgctgttttcttggcttagtaaaccctttccccaaatcttgtcctccttcaagatccaggtccaaagcttgcctcctccatgaatcctttcccaagtccggcaatcagaagggatctctcagtcgtctgaagtctcatagccctcatgcttctttcctgttctctctcactctctgctttgcagcatagttatcagtgtccacatacttcctcccctttgtggtattcaaac

SEQ ID NO: 388889 - DNA, 1073 bp, Homo sapiens
gaaagaaaaatattaattatataatatggcagttcctatgagagtgtggcaaaaatcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttttgtgacttccaaacttttcttcagtcttccgggcccaggggtttggggaagaatgagggagtgtcacctagccttggaataatcagtatttccccaaagcatataattcacattcagtcacataggatttacattcagtctccagtcatgtgtttttattaatcttcagtttttggttctgaggtttgttttttaaaagatggggtcttgctatatggcccaggctggactcaaactcctgggctcatgtgatcttcccgcctcagacgcctgagtaactgggactacaggtgtgagccaccatgtcccacaattttcagttttaacagagcctcaagcttcagctttcacaggcaacacttcctaactagaactttgttaatgttttatattcactgtatttgttttatggttttattctattgttgacaagtgttaactagtt

SEQ ID NO: 388890 - DNA, 2255 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaagccaaaaaaaatctaggtttaactcttaatagaactgagagtccttaatgtactctgttggatgcttttctgtccctacagattttgatgaacagacagccgatgactgggatgtggacatgagtgtgtactatgacagaggtactgggcaaggagtggcaatactggaggtgaaacaggtgccctggccttgcagtgacactttaccagagctagcaaaggctgagacagggtaccgttcccgttcccttggggtagcccactgagagggttcctcttaaaacatctttggttgtgtacattaagtgctagttttggacagagccttcatcctttcttg

SEQ ID NO: 388891 - DNA, 2316 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttttgtgacttccaaacttttcttcagtcttccgggcccaggggtttggggaagaatgagggagtgtcacctagccttggaataatcagtatttccccaaagcatataattcacattcagtcacataggatttacattcagtctccagtcatgtgtttttattaatcttcagtttttggttctgaggtttgttttttaaaagatggggtcttgctatatggcccaggctggactcaaactcctgggctcatgtgatcttcccgcctcagacgcctgagtaactgggactacaggtgtgagccaccatgtcccacaattttcagttttaacagagcctcaagcttcagctttcacaggcaacacttcctaactagaactttgttaatgttttatattcactgtatttgttttatggttttattctattgttgacaagtgttaactagtt

SEQ ID NO: 388892 - DNA, 2173 bp, Homo sapiens
  misc_feature (7)..(7): n is a, c, g, or t
  misc_feature (2173)..(2173): n is a, c, g, or t
aacttanggctaggtacgaggcctgggtgttagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388893 - DNA, 2656 bp, Homo sapiens
  misc_feature (2656)..(2656): n is a, c, g, or t
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctgggtaagagcttctgttccaggcgaagagcagggcagcagctgggctagaatgaagcagacatctcagctgaagccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388894 - DNA, 2170 bp, Homo sapiens
  misc_feature (2170)..(2170): n is a, c, g, or t
gggacagaagagcagcacaaggaaggcaccgatgagactgaaacggattgccagagaattggcagaagtatgacaggtcgatattacatacgtgacgtgaccctggctatccgactccttgtgtgacctagccacgcggtatgcaactagatagcattccgtgcttggtttgcttgtggaacagacagagagacacagagaacaaatgagaaagggaagcacgcatcacagaaacaacaggacttcggagacaagagacagcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388895 - DNA, 1720 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctgggtaagagcttctgttccaggcgaagagcagggcagcagctgggctagaatgaagcagacatctcagctgaaggtagctgcctctggtgccttgtgtggtctggtgatagtagccacaggcaggttctaactcctgcccatttattttgtgccactctgtgctagttaccgttgtagattttggagacaagagagctacagatggtgttaggtgttacaaaggaattaaagtgatacgacagtgaatatttgggagtgaagtgagtgagctttggagtaaaacaggcatgagtttaaattctggatctgccactgaatcatcgtgtggtctgggtaagtcagttcatctctctggacctcagtttctcacttctgctctgaagcagtggcatctgagctgagacatgaatggtgagaaggagccagccaagggaggactgttctatgcagaggcactgtttggactttgagcactgtttagactctgggcactgtttgggctctgggcactgtttg

SEQ ID NO: 388896 - DNA, 1587 bp, Homo sapiens
  misc_feature (1587)..(1587): n is a, c, g, or t
tcctatgaagtagatacctgcctatatagctagtaaatagcagagccagcaggtaaaaccaaatgctttttttcttagtaacttcattttactgtgtcaagaaatatttgagtgcatgagtgcacaaaggaaaaaaggaaaaaggaacctcgtcctcaggtctttagcctgatactggttgctcctgaacactggtttctctctttagccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388897 - DNA, 974 bp, Homo sapiens
caagccctcattctcatgagggaatgcttatcctgtttctccaggccactctcaccctgtctattccctcccagctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctgggtaagagcttctgttccaggcgaagagcagggcagcagctgggctagaatgaagcagacatctcagctgaaggtagctgcctctggtgccttgtgtggtctggtgatagtagccacaggcaggttctaactcctgcccatttattttgtgccactctgtgctagttaccgttgtagattttggagacaagagagctacagatggtgttaggtgttacaaaggaattaaagtgatacgacagtgaatatttgggagtgaagtgagtgagctttggagtaaaacaggcatgagtttaaattctggatctgccactgaatcatcgtgtggtctgggtaagtcagttcatctctctggacctcagtttctcacttctgctctgaagcagtggcatctgagctgagacatgaatggtgagaaggagccagccaagggaggactgttctatgcagaggcactagtaggaataaaggccttgtcttagtcagtttgtgctgccatcacaaaaataccatagaccagatggcttagccaataaatatttatttctcacagttctggaggctggtaagtccaagatcaagacacaagccgatctggtgtctggtgagagtctgcttcctggctcctagacagcctccttctgtcctcacagaaggaggctatattctcacctggcacagagacagagaaggggtgggaggccagggacaaaatagggaagattgaggtagaagcaggctggta

SEQ ID NO: 388898 - DNA, 2584 bp, Homo sapiens
  misc_feature (2584)..(2584): n is a, c, g, or t
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388899 - DNA, 1470 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttttcgcatacgcagtcaagaaagtaggagtcatcgaaatatgctgttcttaaccccccaaccggcaggagcccggagcgcggggtaagcggttgttcgcccagcgatggagttgcgcaggcggccttcccaggcgaatcgcccatggaaggtgaggccgaaaccgggggcgccacccggggtcccgcggtata

SEQ ID NO: 388900 - DNA, 1949 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctgggtaagagcttctgttccaggcgaagagcagggcagcagctgggctagaatgaagcagacatctcagctgaaggtagctgcctctggtgccttgtgtggtctggtgatagtagccacaggcaggttctaactcctgcccatttattttgtgccactctgtgctagttaccgttgtagattttggagacaagagagctacagatggtgttaggtgttacaaaggaattaaagtgatacgacagtgaatatttgggagtgaagtgagtgagctttggagtaaaacaggcatgagtttaaattctggatctgccactgaatcatcgtgtggtctgggtaagtcagttcatctctctggacctcagtttctcacttctgctctgaagcagtggcatctgagctgagacatgaatggtgagaaggagccagccaagggaggactgttctatgcagaggcactagtaggaataaaggccttgtcttagtcagtttgtgctgccatcacaaaaataccatagaccagatggcttagccaataaatatttatttctcacagttctggaggctggtaagtccaagatcaagacacaagccgatctggtgtctggtgagagtctgcttcctggctcctagacagcctccttctgtcctcacagaaggaggctatattctcacctggcacagagacagagaaggggtgggaggccagggacaaaatagggaagattgaggtagaagcaggctggta

SEQ ID NO: 388901 - DNA, 2371 bp, Homo sapiens
  misc_feature (2371)..(2371): n is a, c, g, or t
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgagggggccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgcccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcggagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaaagggggggggcgcccaaaagagtacccccagggggggcccaagaaataagcgaagataccacccaggacatcattggcgaacaaaagaggggccaccataaaggagagacggcgctgaattataacaccccgaacaggagaccggcggaccgaggcggcttaacaacacaacggcacagcagagcgaaggagaaacacgagcgcacaagccaggggagcgaactcatcagaggaggagaaagagaagaacgcactaatcgaacaccaagggaggagggaggaggtgctgagcaacacatatatgtagtgggagagacagaaaaattatagcacctataagcaaagcgaagagctatagtacaaagagcgcggtctctggacgagagggtgaacgtatatttctactaacactatctgatccgacgagagggttgtgtaatatacagcgtgtggtgtgtacaagcagacgacggaacgggtgtagaaacatattatatgcagaagtgaggaacgagggatagttggggaagggagatagtatgtaggagcacgataacagcgggagaactgtatgattgtagatatataggagggagagacaagtatttattattataacgcagggggggagggtacgttgacatgttgtcaagaacgagaacgaggaan

SEQ ID NO: 388902 - DNA, 1551 bp, Homo sapiens
ttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggagctcccttacttttctaattcgagtctgaaggttagagaaattccgagagcgattttcccgcaaagaccccacattcgacccactacccgcgagagaaatgcggctgcgccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggcccccatactgtcagtggtgtccgtgagctctgggccctgccaccagaaagtcgagcactggtcctagtcaggctgtgatgaaatgtgctacaatacaagagtttattttctaaaaaaaaaaaaaaaaaaaaaaaaaaaaaaaaaaaaaaaaaaaaaaaaaagccaaaaaaaatctaggtttaactcttaatagaactgagagtccttaatgtactctgttggatgcttttctgtccctacagattttgatgaacagacagccgatgactgggatgtggacatgagtgtgtactatgacagaggtactgggcaaggagtggcaatactggaggtgaaacaggtgccctggccttgcagtgacactttaccagagctagcaaaggctgagacagggtaccgttcccgttcccttggggtagcccactgagagggttcctcttaaaacatctttggttgtgtacattaagtgctagttttggacagagccttcatcctttcttg

SEQ ID NO: 388903 - DNA, 347 bp, Homo sapiens
ttttcacatagatataatgtccaaaagtgtatatgctttaaaaaaattgtgattctactaacttgctttttccctcttcctcaataagattattacaggatttatttttaatttttaattaagatccaggttatacaagtagtttaaaataatgagttctacaaagtttgttaagaaaaacagtagtccaggttctggttccagataagatggagtaagcgcacttcactctgtctctcccactgaatgcagctaaaaacctgggcaaaattcttggagtggctatttgaggactctgaaaagtaaattgtaggagacagactggggaagaagaccaaaattcaaag

SEQ ID NO: 388904 - DNA, 701 bp, Homo sapiens
tgccctgtgaagaaggtgcctgcttctcctttgccttctgtcatgactgtaagtttcctgaggccccccagcaatgtggaagtgtgggtcaattaaacctctttcctttataaattacccagtcttgggtatttcttcatagcagtgtgagaatggactatatacaacctccagtgattgttgacaggagtcaggataagtaaactgtggcacattcccatttgccacatgggagtaccatgcaaatgaatgaatagctatggccaatcaacatgggtatgaaacctaatattgaaccaaaaatattgttatggaatgcttgatgtttgattctacttttacaaactttaaaaattataaactaaatgtatattgttaaggattacatttatatattattaagggatgtgtttataaaaaaatttaaaaatcaataggacaatagagacaaaattcaggagagtggctacaactgcattaggaggaagaggaacacagggttaatttttttggtaatagcttcactgaggtataatttacatactgttgacggtgattgtgagacctctgttcttgtcttcttggttaaaataattttaacaagagacacaaccatagaggatcgcttgaggctaggaattcaatactagcctggggaaaagaaaagaaaaagaggaaggaaagccaaagaagaagaaaaa

SEQ ID NO: 388905 - DNA, 813 bp, Homo sapiens
tgccctgtgaagaaggtgcctgcttctcctttgccttctgtcatgactgtaagtttcctgaggccccccagcaatgtggaagtgtgggtcaattaaacctctttcctttataaattacccagtcttgggtatttcttcatagcagtgtgagaatggactatatacaacctccagtgattgttgacaggagtcaggataagtaaactgtggcacattcccatttgccacatgggagtaccatgcaaatgaatgaatagctatggccaatcaacatgggtatgaaacctaatattgaaccaaaaatattgttatggaatgcttgatgtttgattctacttttacaaactttaaaaattataaactaaatgtatattgttaaggattacatttatatattattaagggatgtgtttataaaaaaatttaaaaatcaataggacaatagagacaaaattcaggagagtggctacaactgcattaggaggaagaggaacacagggttaatttttttggtaatagcttcactgaggtataatttacatactgttgacggtgattgtgagacctctgttcttgtcttcttggttaaaataattttaacaagagacacaaccatagaggaacaacagaaagcaatgtattgcaaaagagaaagaacactctgaaagctgagtgtaaaaagaaacagctgaaagtaatttagtgcaaagataaaactctgaaagatacactctgaaaggtacactctgaaagataagtcagagtgggctgatcaagagtgagtcagcaaagactggctctgagggaactccc

SEQ ID NO: 388906 - DNA, 832 bp, Homo sapiens
ctacccttttccccaccctcggcccccattcctatgagtagaagcctgcccagctgcggtggtggggtttgaggaggctaggacttagagcagggaaaaacaaggaagcagaatgaaaaacagaaacacttagaaatctgggattggtacttctccttatgtaaagattgtggctgacgaccagcttcttagaggaagcaagtctaggagaagggctcatacctggtccgtgagggcctatgggggatcagggcataagaccacctgaccctgggccttgcatccacaagaaccttgagtttagatttttagacatattcttcgaacaaggttttacatatatagtcactgagaaatcctgagaggattgaaaaatagcatctattttacagctttaaattgtgccctgagctgagcgtggtggctcatgcctgtaatcccagcactttgggaggctgaggtgggaggattgcttgagttcagttcaggaccagcctgggcaacagcaagacctcatctctactaaaaataaaaaaattagctgggcatggtggtgtgcacctgtagtcccaattactcaggaggctgaggtgggaggatcgcttgagcctgggaggttgaggctgcagtgagctgtgattgtgccactgcactccagcttgggtgacagagtgagaccctgtctcaaaaaaaattctgccctgttattagatcgggctgctctaagtccattatcaattaacattctttatatgtcctgtgtttatcttgtgcacggtataattgccctatgctgtattttttaaaataaaaacattgctttttaaaacgc

SEQ ID NO: 388907 - DNA, 517 bp, Homo sapiens
gtaacaaatgctgtcaaaccttcccacatcccttatacttttcccactattagtatctgcacatgcacccaaagagctgttttttcctaaaactgcagaaatatgtgttgcctatgcaagtggcaggcaggaaacttcaagaactcaacacttgataggtgaggtaattttgagcagggttttaaataagtttccttgcagaattaagttcaagtagctcactgtagatctgacttactaatacgccacgctatcgtccctgcatttcccaaataagctacttgcattaaaaaaaaaaaaaattatcgaactacttttgaccacctctaccatcactctgggacaagcctccatcatcacttaattgaattatttaaataagttcttaactggtattctttcttccttcttcccttcagtatattttttacaacagccagaatgatcctgttaatacataaatcacattctaccattctgtttaaaatttttaaatgacttcccatcctactcacag

SEQ ID NO: 388908 - DNA, 419 bp, Homo sapiens
ctctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaag

SEQ ID NO: 388909 - DNA, 3551 bp, Homo sapiens
gaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctggggagacccctaatgaggaagttgaggtaatgcttaacattgttgctgtgagaatttactgccctgtgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccggggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacgtgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagccactggtcatttccccatattcgtagtctttttttccatcctatctttctaatatttgttgtctttaacaaactgtgttctgtgtctgtgctcctccttccctctcagaccattggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388910 - DNA, 3167 bp, Homo sapiens
gaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctggggagacccctaatgaggaagttgaggtaatgcttaacattgttgctgtgagaatttactgccctgtgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccggggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacgtgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctcattggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388911 - DNA, 707 bp, Homo sapiens
  misc_feature (352)..(352): n is a, c, g, or t
gaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatataagcttnccaccccaacaatgcccaactgtactgtcatatttaacaatggcaatcatgaggcagtgaaatccatgtttcatacccagatgagaattgagctccgggccctaggcaagatctcagaaggagaggagctgactgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388912 - DNA, 175 bp, Homo sapiens
taggcatcttccccaacctgggcctggtgaaccatgactgttggcccaactgtactgtcatatttaacaatggcaatcatgaggcagtgaaatccatgtttcatacccagatgagaattgaactgcgggccctaggcaagatctcagaaggagaggagctgactgtgtcctatat

SEQ ID NO: 388913 - DNA, 3150 bp, Homo sapiens
tgcggccgctccaacatcagaatggcataggctttgcagataacaatgacaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctggggagacccctaatgaggaagttgaggtaatgcttaacattgttgctgtgagaatttactgccctgtgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccggggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacgtgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagccactggtcatttccccatattcgtagtctttttttccatcctatctttctaatatttgttgtctttaacaaactgtgttctgtgtctgtgctcctccttccctctcagaccattggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388914 - DNA, 1588 bp, Homo sapiens
tgagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagccactggtcatttccccatattcgtagtctttttttccatcctatctttctaatatttgttgtctttaacaaactgtgttctgtgtctgtgctcctccttccctctcagaccattggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388915 - DNA, 1536 bp, Homo sapiens
gaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaatgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaagtgt

SEQ ID NO: 388916 - DNA, 318 bp, Homo sapiens
actttgtgtagagatgagttctccctatgttatccatgctggtctcgaactcctggactgaagtgatcctttcaccttggcctctcaaagtgctgggattactggtgtgagccaccgctcacccggcctccacatgttactcattcagtaacattactacttgtttttaatcaagagtgatagaaattccttgacctgataaatacaacatatggaatatgttttaagttttctttggcgacttaacaccattattaatatcaattactatactcatctctaattaaaaccataaatggaattttagctgctcaccaa

SEQ ID NO: 388917 - DNA, 410 bp, Homo sapiens
ttctgcagattggacaaggagcatggcaccagaatctgcctttggtgaggtcctcaggctgcttccactcatggcagaaggtgaaggggcttcagcctgtgcagagatcacatggtgagagcagaggcaagagagaagaggtagatgccagactctgtttaacaaccaacaaccagcaatcattggaactaatggagtaaaaactcatttattactgggaagactgcagtaagccattcatgatctgccccatggcccccaaacccccccccttaggccccacctccaacactggggatcaaatttcaacatgaggtttggaggatcaactacccaaactatagcagaatgtcactagacccatgaaatataatttgtattttattgttcttactagaaattaacacatt

SEQ ID NO: 388918 - DNA, 425 bp, Homo sapiens
aggggcatttttttaaagcctcactgaaaatccacaggattatcagtagaatttagtaagtgcccttggtgggtaactccccatggaagcttttccttccacacggtcagtaggtctaagaacacaaaaagtattttttggctttcctatattttcactggtggaagtcagcccattcacacctagtgaatagaaaaaaaaagtagctttaggttaatattacaataaatcaaaaagaggcagatggctgcatcttctcagagctacctctattcctgcctaagaatcaacctcatgagcttggtagaaggacattctgctagttattctttcttgaaagaccaggaatatcaagagatttggatttcagaaaaacaatcccctaatttttaaggtttttattcatcttgtcttccacccgtagc

SEQ ID NO: 388919 - DNA, 322 bp, Homo sapiens
caagatgggatggggaaaaagtgagatgcgtttctttagttgagtcagtcagcttatgcagaaggaatgagagttcctagcctagcaatggatacttcagacactgtttcccatttctacaaagggaccttattagggtttattaggtgacaaaatggggtggaaaaaaggagcacataattagaagggactaattaaaataccttcctctctggatactggagatggaatgaaaaatgattagtattgataagaggtggtagagtggcaaggaagaatttgggaattagaggacagaggagtgctctgcatgcttgtcatt

SEQ ID NO: 388920 - DNA, 5433 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388921 - DNA, 446 bp, Homo sapiens
catcaacagtgcagctacaaaatcctcacgtccgtggaccaatacctggagctcattggcaactccttaccagggaccacggcaaagtgcggcagtgcccccttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaaaagaatgtctttttc

SEQ ID NO: 388922 - DNA, 567 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgtaagtacttgacatttcaatttactctttggcttcttatttataaagtacagtgttagaatttgatgatctatagatttattgttcgtctccatggcatcacttgaacttactctgtttttatgcttatgaaccgtatctagagtgtgtaaaatgtttttaaaatacaagcctctgaaaataaaaatctgcttattaaaa

SEQ ID NO: 388923 - DNA, 399 bp, Homo sapiens
ccacattgtcattttaatcttggacactcaggcagcagagaaatatgactgcatggtcttctcctcctcacaggttagtccgttcattgatgacaacaccagaaggaagttcctcatttatgcaggaaatgactaccagggtcctggaggcctgctggattacatcgacaaagagattattccagatttcctgagtggggagtgcatggtatgtcctgaggcgaggaactgcacatttggccccttatgcaggtggaagggtggggggaagacattcaagtttatatacttcttctgtaaagtctatttgcatggcattaggacactcacattttgtttttcccctttcttaaacaatttgagaaattttatatctttgcatgtattactttctggggc

SEQ ID NO: 388924 - DNA, 5304 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388925 - DNA, 4939 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388926 - DNA, 4384 bp, Homo sapiens
tttcaggctggtacgcccccgcggtatgggctatcgtggacccacggcgtcgagggagacccacaagtgcacaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388927 - DNA, 3750 bp, Homo sapiens
  misc_feature (95)..(95): n is a, c, g, or t
ttgctgtggttgatctagaggatcccgctacaatgccaaggtgatcggtcggaggatttcagaggttccatgacgagcctggagtcagccacagnggttctcccagctgagtgcgccaccacccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388928 - DNA, 5609 bp, Homo sapiens
  misc_feature (5441)..(5441): n is a, c, g, or t
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttacgaacacnacacaaccggcgccgcgtcctaatttccccggagggccccagttacgcgctcgcgcgttctgatcacggcccaacggagcgttttaacagccggccgtacacgtcggctgaaaagggacggatcgcaggccacttcgggggcacggacccccgcgtggtagaaacgtc

SEQ ID NO: 388929 - DNA, 2253 bp, Homo sapiens
cgcacacgcacgccaacacacctacggctaggtagcgaggcctgggtgtttagccatcctcactgacagttcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388930 - DNA, 4810 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactctttttctataaggcatacccactctccttctagatttatttttaccaatcaaccttgcaatgtttgaaccctatacctacttagt

SEQ ID NO: 388931 - DNA, 2760 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcaga

SEQ ID NO: 388932 - DNA, 777 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaa

SEQ ID NO: 388933 - DNA, 1757 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgtaagtgcgcggctgcgagactccaggtgccactgtggcgtcactttttttctctgccagtaggattggggtgttaaccagcctgttagaacaaacatgaattgcttatgtagttaggactgaaaatatattaatatcgtcttaaaatttcaaaaggagacacagaagttataaaagtgtttctcacagtggaagcgtcagtgaggcagtcagggtctcccccgagatgcctgtgtagcagcagtttgagtcttttcattcactcccatgtggaattgccctctcttggggtatggacgccacatccagcaataccacatggaagattcagagatcaaaggtgaagtcctctatct

SEQ ID NO: 388934 - DNA, 578 bp, Homo sapiens
ggcacatgtggtatcagagtgttctcacactcacagacattcatctcctgttcccatgcacttgttctgaagacagagccccagagccaggcccctgctcatctggggatacctctgtgcttcactttggatagccgttacctttgccacacatgacagtgtttattctctttcaaaagtagaatttatttgttggtggtgatgtgtttagcgcatgtgaatgtgtaagaaaatctccataggtgacttttttgatttacatgcttatctgtaatacgctgttagtgtccctcttccatagctggacgcggtagttttagccttaaactaatcatggtaaattttcatgcccttttgtatgtaggttctctccataaatgaagaagggctaaggcgatgcgaagagaatacaaaagtctttggtcggcctatcaggtagatgtgggattttgtttttcctttcaacttactgagaaaacgaattaaatatttctagttgatttttggaattaaaatctacttattattttccaaggtgctctaaaaggtagacaagaagtgaacatgtaatatgccag

SEQ ID NO: 388935 - DNA, 409 bp, Homo sapiens
ttggtggtgatgtgtttagcgcatgtgaatgtgtaagaaaatctccataggtgacttttttgatttacatgcttatctgtaatacgctgttagtgtccctcttccatagctggacgcggtagttttagccttaaactaatcatggtaaattttcatgcccttttgtatgtaggttctctccataaatgaagaagggctaaggcgatgcgaagagaatacaaaagtctttggtcggcctatcaggtagatgtgggattttgtttttcctttcaacttactgagaaaacgaattaaatatttctagttgatttttggaattaaaatctacttattattttccaaggtgctctaaaaggtagacaagaagtgaacatgtaatatgccagtgacgagggacagacagttagtg

SEQ ID NO: 388936 - DNA, 373 bp, Homo sapiens
tgtggtatgatgtgtcagtgcagacttactaataatttgtttctgcattgtggttacttatcacatatatttatgttttgcaggtgtgagagggttgctgttgtattgcaatcatggtgcagaaataccagtccccagtgagggtgtacaaatacccctttgaattaattatggctgtaagtacttgacatttcaatttactctttggcttcttatttataaagtacagtgttagaatttgatgatctatagatttattgttcgtctccatggcatcacttgaacttactctgtttttatgcttatgaaccgtatctagagtgtgtaaaatgtttttaaaatacaagcctctgaaaataaaaatctgcttatt

SEQ ID NO: 388937 - DNA, 398 bp, Homo sapiens
gctgtctttatggtagtagcattgttagtaacgtaagtgtttttttctggttactggttaaactgaggagcaggcagatgatattctgttgtcaattcagtcagtgagagtgctttctctttatctgcaggttcaccctgaaaatgaagattggacctgttttgaacagtctgcaagtttagatattaaatctttctttggttttgaaagtacagtggaaaaaattgcaatgaaacaatataccagcaacattaaaaaagtgagtgtatcttgggattttgtggcagagggtgggcaggagtctctgagatgaccatctttttggaaggctggggatggcttagcaagggatttgcagcatttcttgggtggaagatgctatgatccctaccccctgc

SEQ ID NO: 388938 - DNA, 918 bp, Homo sapiens
cacagagcttggtgcatgacatgtagcaggatccagcggttgaatggatggtggtgtgtgactctggggaaagagatccgtccatacgcattcagcgtttccctccccagcttcagcacctgcaccctggatcccctggagagcacgatgcgctcgcagcatgccggcctggtgctcgtggatcgtggctgcctaacgctgcctctttttcagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcaggtgcggccaccctcgccacagcaggtgctgcggacagctgggcatggttggagggagcctgcagtcccacgccgtgtgcaggatcagcagtggcggcgggtgtcaggaatgcttggagggccaggagggagtggctttggggtcatttgttggcacggtgactccctgcctgtctgcagagggagagtgtcggagacagagccgactgactgcctttgctttagctcacactgccgtctgcgtgcaggctgtgggaagccggtccccctggtgg

SEQ ID NO: 388939 - DNA, 601 bp, Homo sapiens
  misc_feature (510)..(510): n is a, c, g, or t
  misc_feature (536)..(536): n is a, c, g, or t
  misc_feature (557)..(557): n is a, c, g, or t
  misc_feature (590)..(590): n is a, c, g, or t
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctcactcaaaccagtgaagcttgggaaagtcattgacctccagtcgttctgctgaggaaacatctgggctctattttccatgggaggaccaggggaattctggaaggatttgggaaaaggacccgggaggaaaattcaggcaagtngatccaatgggaacactggattaatngaaccagccaaggtggaaacnggagttaactccccggaaaaagagggagatttntcaaggttgac

SEQ ID NO: 388940 - DNA, 5522 bp, Homo sapiens
cctgcggaattgggctcgccccgggacgataacagagctctgccgggggctggaggcactgaccgggtgaccagagacccagagaccagaccccctccacggcgcccgggatttcggggacggcttctcccatcgcaagtttcaacagaaaatgagaaatatcccccgacgattggctgaaaacatgcagcaaccactattttcttcctgcccctcgttgatgagagcattcgaagtgacctcagcagggcatccagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388941 - DNA, 4313 bp, Homo sapiens
acagctttttggggtaaatattggacacacaccccctatcacacaaatcagttgccacttctaagaatcagaaagacttttaagcgcccctagaacacaggcgaacacatattcctgttaagggtcttagagttgtatcctcagtttcaactgggatggtgctgacaactcattccttcccctcctctgcagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388942 - DNA, 2993 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactattta

SEQ ID NO: 388943 - DNA, 5455 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaaaagaatgtctttttc

SEQ ID NO: 388944 - DNA, 5113 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcaaggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggttagtaggtagggctagtaggtagggctagtaggtagggttagtaggtagggttcgtaggtagggctggtaggtagggttagtaggtagggctagtaggtagggttcgtaggtagggctagtaggtagggctagtaggtagggttcgtaggtagggttagtaggtagggttagtaggtagggttcgtaggtagggttggtaggtagggttagtaggtagggctagtaggtagggctagtaggtagggctagtaggtagggttagtaggtagggctagtaggtagggttagtaggtagggttcgtaggtagggttagtaggtagggttcgtaggtagggttagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaacaacgcgactgaggggtcctctagagtcaat

SEQ ID NO: 388945 - DNA, 2034 bp, Homo sapiens
caagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagttgattatgtttattttgtccagaaaaactcactgaattctcgggaacgtactttgcacattgaggcttataatgaaacgttttccaatcgggtcatcattaatgagcattgctgctacaccgttcaccctgaaaatgaagattggacctgttttgaacagtctgcaagtttagatattaaatctttctttggttttgaaagtacagtggaaaaaattgcaatgaaacaatataccagcaacattaaaaaaggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagtgcacctgagcccgtggtgggcacccctgacgacaaactagatgccgactacatcaagagatacctgggcgatttgactccgctgcaggagagctgcctcattagacttcgccagtggctccaggagacccacaagggcaaaattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaagatgggcggcccctctacgtgctcaggctggggcagatggacaccaaaggcttggtgagagcgctcggggaggaagccctgctgagatacgttctctccataaatgaagaagggctaaggcgatgcgaagagaatacaaaagtctttggtcggcctatcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggttagtccgttcattgatgacaacaccagaaggaagttcctcatttatgcaggaaatgactaccagggtcctggaggcctgctggattacatcgacaaagagattattccagatttcctgagtggggagtgcatgtgcgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacatctatcactccctctccctaagaccctagggatcctctaga

SEQ ID NO: 388946 - DNA, 685 bp, Homo sapiens
gtatgaggctgatagcccctttgttttggctaatttctcctatttggaccgggtatttttacccaatgcctgtacctccattgtatctaggaagtaactaaattgcttttgattttacaggcaggagggtcttgccttgtctcagatgagactttggacttggacttttgagttaatgctagaatgagttaagaccgtgggggactgttggaaggacatgattgtgttttgaattatgaggacatgagatttggaaagggccggggcagaatgatatggtctgattgtttcctcatccacatctcatcttgaattgtagttcccataatccccacatgttggtggagataatttaatcacggaggtgttttgccccatcctgttctcgtgatagtaaaaacactatttcacgagatctgttgggttttttgttggtttttttttttgagacagagtctcgctcttttgccaggctggagtgccatggtgtgatctcagctcactgcaacctctgactccctggttcaagttattcctgcctcagcctcccgagtagctgggattacaggcacgtgccaccacgtccagctaatttttatatttttagtagagacagggtttcaccatgttagccaggatggtctcaatctgctgaccttgtgatccgcccacctcgacttcccaa

SEQ ID NO: 388947 - DNA, 865 bp, Homo sapiens
aaccactgtgcccagccggcaccaaaacttgcacctatcctaaatatggagcttcagtgtgcggccgggaacttcctgtgccccgctggcgccttgtccttcaacgccttcaagaccgtgatggacatcgataccagcggcaccttcaatgtgtctcgtgtgctctatgagaagttcttccgggtgggtgcctcgtgcgctctgtgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggaatcttccggccgctgcttcctgccgcctcactcagccaggtggagagcaccaatctgaaccagcaatgcctgcagcccagcccctcctctgaacactcagctattactgcgctttccctccccacgcccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388948 - DNA, 1524 bp, Homo sapiens
cggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388949 - DNA, 956 bp, Homo sapiens
agcggccctttcatatccaactttcttctgtgcagacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388950 - DNA, 1496 bp, Homo sapiens
cggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggctgtgcttccccagagtggggtccagcagcaaacccagggtccccgaggaacccggaagcatcgtcctctgcagattccaaaggccttttctccaggccgaggctgcagggctgctgtctgcctctttacctggcttgccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388951 - DNA, 727 bp, Homo sapiens
cacggaggggtgatcgtgaacatcactgccaccctggggaaccgggggcaggcgctccaggtgcatgcaggctccgccaaggccgctgtgggtatgaccacccccccccgcccaggtttgcccacgtgggtccccaatgggccgtctgcttccatcccaggaggccagcagtctccacttgaagctgagcccagctgcaggcagcgagacctggccttggccctgcgccctcgcagagggcagagcggccctttcatatccaactttcttctgtgcagacgcgatgacgcggcacttggctgtggagtggggtccccaaaacatccgcgtcaacagcctcgcccctggccccatcagtggcacagaggggctccggcgactgggtaaggctctcagggagcccaggcctcccacagatcctctcctggggcacagggtgcccatgaagcttccagaaccttggcagggtgtatgttgaaaagccctgtgctggttccatggtggcaactatgttctgtgcctggcctgatcctgctccatgctaggccttggtgacactgactgtgtccttgctgttcccagatgcctctcagggaatgagctgggggagaggggagggtgctgggtcttggggctcacggggcctgagccttctgctgccctccaggtggccctcaggccagcctgagcaccaaggtcactgccagcccgctgcagaggctgggga

SEQ ID NO: 388952 - DNA, 1576 bp, Homo sapiens
cggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388953 - DNA, 1488 bp, Homo sapiens
ggccaagttaggccagaatctgactgggacgtcaggccccaagtccccggccccgccgctgcccggcccccccagctgccacctcacaggacgatccatgtcccagggctccctccatcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388954 - DNA, 1522 bp, Homo sapiens
ggccaagttaggccagaatctgactgggacgtcaggccccaagtccccggccccgccgctgcccggcccccccagctgccacctcacaggacgatccatgtcccagggctccctccatcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388955 - DNA, 1358 bp, Homo sapiens
cggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388956 - DNA, 1490 bp, Homo sapiens
cggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatccta

SEQ ID NO: 388957 - DNA, 570 bp, Homo sapiens
cgatttcaagccctctatctactcttcgactatcccaactccaacaactcctcgatcctattccttgaatccactgaccccatgacctcttactgaccctcagctccttcatgcctcctggctccttgcctggcttagaccacatggtctatcctcaatcctcacatcgattcttctgcgcaatgctcaactcccttatgcctcctccctccactgtactcacctggcaaaatcctaatcccaggttaaatccaactccctgccctctcctgccctctcctgccctacacttaggctgccgaaagcagaattccttcagagcaccagctcagctccctatccagtcgtttttgcttgaaccacctggaactgggcttttattctcaccatttcactcatacagctcttatcaaagtcaccaacgatcgccccgctaccaagcccacagtgaaacccgtctgtttcttgctccagctttagcagcatctgacatagatatcactctgctttgaaacatgagcttccttgtccgggcgcggtggctcacacctgtaatcccagcattttggg

SEQ ID NO: 388958 - DNA, 4204 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtagcaatgatgcaaatagtcagctgcccgtatgtaaagacagtcgctaccaccaagaccggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388959 - DNA, 1130 bp, Homo sapiens
taaaagatagcattttagtgactttctattctttcagtaaacatatcttacatataaattattgcttatcagaattaaaggtcagctattaaagattaatgaattccaaatgtcatttgatagcagtgtcaggagtggagaggagcttaccactggggaggaaaactagtagggagatgaccccagtggtgtgtgaaccatcaaaacatgcagccactctccttagtgtcctggtatgctttgtgaatgtagaaaaataacctctggagcctaatcattcttgacatttaaaattgcctcttattccagaaagttataatattacaagttctattaagaaatgttgtttgaaagtaatgctactcctgggaagaagtctctttcattcaaaatagtaacagtattagctaaaacagcttttatcagaaatacctgaaacctcctaattatccgatttattgggcttccaagtgagttttccagaattgtttcactgtttacttaaaaaatgattatgcttctcagaggaaatgtgtaaaatcaaattctactacataattttatatgttgaattagaatcatgttaatgaattatttgctacttttgattttagaataacctatttaagaaaaccaagtaaataagtgattgtttgattttgtatgattgcttttatagaaattaaatgtatttatatttgcatttgtaactgattttctttttctaaacactttttttataactattttatgtattctgttttataacaagtggatagactttacagttttgtgctgtgcggcctgtcaatcagttcagtgacagctgtcaatcactgacacgcaaagtgttatgggattccctagtgaggaaagaattggtatctctgtgtggtgactttagcctcccgagttccggtactttacatttttttagtctttttccttatgaagtgatgagaattgtgcccagaatgtgttaattttaaaaaagaaattaaatagatatgacatctaaattaaataaatctaatatttaatatattcagctttattttattttggctataaaaatcttaattctttaaattacagggttggctttataccattactagattaaaaaaaaa

SEQ ID NO: 388960 - DNA, 609 bp, Homo sapiens
catttaaataaaaattgtaaattatgaaatcagagcctttaaacaagatttctctgtagcaaacccaacagttcttcacccctaacaatttatcatcaggaaaacaatttcgcattgcttaccagtcagtatgcaggaaaccatttttgtttcatgctccagcttttcttctttaagagagaaatttgaaacatcttaataaagggtatgtgcacgggaggctagatagtgctgagggtgtggtttttagatattttgtcatttggattttttggtcaggatccttaatgttttgcatcagcttgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacccacccaccctcagccctgatctggagggaccaccactaggggtgggagggtaattcagcttctgaggccctttcactccttggagtctttgctgaggcgacttacaaaggtgaccactgccgtgaaatttttcttaaaa

SEQ ID NO: 388961 - DNA, 887 bp, Homo sapiens
ttatattccctatgaatacatggcagttctgagatctaaagttatcaacaatctgaaaaagcctttttctatattttaataatttctttataaaatattatttatcttgaatttggcaaattttagatgaaagcctatatgcttgtcgatgtttacatttctagtaaaagaacacttctgatcttttactgtaattctactctaaatgcctatattttaaaagttattattctcatatttaaggtaggtgaactttttttctagttgtaaatatttaagatatgatgaatttctcatggtacattattttccctcccatcccactacctgttttaaaatacagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtatacgttaatcttttactttttttctctaaagtactggatattggaaatttattatgttactgttatgaatattttaatgttctttaattctgagggagataatttgctaaattagaaagcatttaaaaattgaatacttggtattagtactgttagtataggaaaaaacccaagttattcaacaaattcagaa

SEQ ID NO: 388962 - DNA, 4235 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagttaatttagtgaaagatgtgaaagtgaaagcttgtgaaagatgctgggattggcagccccgcagactgaagtcctctgttcatccacagaacagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388963 - DNA, 4306 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatataaaaaaaaaaaaaaaaattgtggcgctcggctctaaaagttttaacatcttgtgggcgcgcccatagtatgacatgtgcaagcgttccagagacctggcagaactggggtggctcccaaataacgggggcgcgggttgcacacacaaggttggctcatgctcaaga

SEQ ID NO: 388964 - DNA, 5582 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagaatgtcaaagaagtcctttatgtggattgcccgagcttctctatttaggtacaaagctaaaagcctgtttttcctggcttagtttttcttttatttcctttattgagatagatagtgatagtttgtattgtgacattttcatttagtatagttctataaaggttatttgtttttattagttacttcttggatgtcttttaactctaactatttaaatagttttaaaattattattataagagggtatattgtttggcaaattgcttttacctgtttgttttgtgcatatcttaggtcacagactatctcgctaagttcctgcaggtcacggactatgtcttctatttcttttgattcattgcctaagttgctaagtacctctcacttgcatttgtgggttagccttagttccatttaaatctctggggctacctacagtttcctgtatagcatgcttttgaatttccacatgttctgttttcctaattcccttaagtttgtatagggaataagagccaatttttaaaatatacttagcagatcatatttaagaaggaagatctgctaaaatacacccagatattattgaattacatactttttggattatttacgtgaatgggcctttttcatagtgcatatatttgagaggtgccgtgattccatgtttacaatttcacttgagtaccacacagaaacagggttgcccttacacctgaggtgcatttttggaggaacaagaagtagtttagtcattgatgaacagttctaattccacctaactactcctgggcccatgttgctctctgggacctgtccttcaacttaaatctcaacttatcacccagaaagtgagtaataaaaagtcaggtaggtaaggtatatatcttacatattcacttggccaagattgcagatattttagttttatttttaaaatgaatgtttgagattactaaaacattataccacttaataccaatttttattagattttacaaaatattttatgtgtttataatgtaaaacattttggaaaatactgttttttctatatttcaagaactaaaaaaattatattttgtgctgtttgattctgacacatagaggtttactgcagtgttaaacttttttttttttaagtaaggttgctccctttttatgttattaaccagtgtcagggagagacagcccattaaaggtgtatttttttcctaataatgtagccattgtaaatcattagaagcccattttaattttgttattatgaaagttatttatcccttagagttcatttgaaaccctcaatataatttgtttttgccaaaaatatgctgctcagtagtgagtcttgaaaattcctttgattttaagatttctaataagatctgagaattaatattttgtcagttgatgtcttatattttattttttataggagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388965 - DNA, 4530 bp, Homo sapiens
attctttttggaaatttattaggtctcaattttatgaaaagttagtttcctccctcatttagaccccaatggataccattccagagatctcataaaaacagacacagacttctccctctttatatggttatcttacgacttacctagtccttgagtctggtcattaactccttggtgaggagagaacccataagcttaggaagtgctctgcgagaaagagactgctaagaagtagaggcattagcttggccagtgctctagagttgggtaaaatgtaaatgttatggcggggggaaggatggggtagagggtatgcatgtatggggaatgggaccattatttagcagcaaaaaggaaagtttgaagacattaacaggaactggttaattgtagtccttatctgaaaaggacagattgaatgcagccaaattatggcaaagaaatcagtaggacaacccctataaagggtagttcttttaaaaaaaatttctttattggcaacaacataaaagatatgaaagaatcactcataatttatcagcgtaacatagctattctcatttttgcaattgactttttagttcttgaccaaatgtaatttttattagttgtgattaactgattttgtgcttttttttaaaaaaaaaaaaacctagaataagacatttgttttgttaattattataaatgactgtattcattctgtttatgtaccataattttggatgttcctacgatgttaaacttttaggttgtttttaattgtttgttcttatagacaactctgtaaggtttttaactgcttttatcaggagaatgtcaaagaagtcctttatgtggattgcccgagcttctctatttaggtacaaagctaaaagcctgtttttcctggcttagtttttcttttatttcctttattgagatagatagtgatagtttgtattgtgacattttcatttagtatagttctataaaggttatttgtttttattagttacttcttggatgtcttttaactctaactatttaaatagttttaaaattattattataagagggtatattgtttggcaaattgcttttacctgtttgttttgtgcatatcttaggtcacagactatctcgctaagttcctgcaggtcacggactatgtcttctatttcttttgattcattgcctaagttgctaagtacctctcacttgcatttgtgggttagccttagttccatttaaatctctggggctacctacagtttcctgtatagcatgcttttgaatttccacatgttctgttttcctaattcccttaagtttgtatagggaataagagccaatttttaaaatatacttagcagatcatatttaagaaggaagatctgctaaaatacacccagatattattgaattacatactttttggattatttacgtgaatgggcctttttcatagtgcatatatttgagaggtgccgtgattccatgtttacaatttcacttgagtaccacacagaaacagggttgcccttacacctgaggtgcatttttggaggaacaagaagtagtttagtcattgatgaacagttctaattccacctaactactcctgggcccatgttgctctctgggacctgtccttcaacttaaatctcaacttatcacccagaaagtgagtaataaaaagtcaggtaggtaaggtatatatcttacatattcacttggccaagattgcagatattttagttttatttttaaaatgaatgtttgagattactaaaacattataccacttaataccaatttttattagattttacaaaatattttatgtgtttataatgtaaaacattttggaaaatactgttttttctatatttcaagaactaaaaaaattatattttgtgctgtttgattctgacacatagaggtttactgcagtgttaaacttttttttttttaagtaaggttgctccctttttatgttattaaccagtgtcagggagagacagcccattaaaggtgtatttttttcctaataatgtagccattgtaaatcattagaagcccattttaattttgttattatgaaagttatttatcccttagagttcatttgaaaccctcaatataatttgtttttgccaaaaatatgctgctcagtagtgagtcttgaaaattcctttgattttaagatttctaataagatctgagaattaatattttgtcagttgatgtcttatattttattttttataggagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388966 - DNA, 4192 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagaatgtcaaagaagtcctttatgtggattgcccgagcttctctatttaggagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388967 - DNA, 2105 bp, Homo sapiens
ctgcctctagaggatccaccgccatttacaactatctctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388968 - DNA, 2699 bp, Homo sapiens
taaaagatagcattttagtgactttctattctttcagtaaacatatcttacatataaattattgcttatcagaattaaaggtcagctattaaagattaatgaattccaaatgtcatttgatagcagtgtcaggagtggagaggagcttaccactggggaggaaaactagtagggagatgaccccagtggtgtgtgaaccatcaaaacatgcagccactctccttagtgtcctggtatgctttgtgaatgtagaaaaataacctctggagcctaatcattcttgacatttaaaattgcctcttattccagaaagttataatattacaagttctattaagaaatgttgtttgaaagtaatgctactcctgggaagaagtctctttcattcaaaatagtaacagtattagctaaaacagcttttatcagaaatacctgaaacctcctaattatccgatttattgggcttccaagtgagttttccagaattgtttcactgtttacttaaaaaatgattatgcttctcagaggaaatgtgtaaaatcaaattctactacataattttatatgttgaattagaatcatgttaatgaattatttgctacttttgattttagaataacctatttaagaaaaccaagtaaataagtgattgtttgattttgtatgattgcttttatagaaattaaatgtatttatatttgcatttgtaactgattttctttttctaaacactttttttataactattttatgtattctgttttataacaagtggatagactttacagttttgtgctgtgcggcctgtcaatcagttcagtgacagctgtcaatcactgacacgcaaagtgttatgggattccctagtgaggaaagaattggtatctctgtgtggtgactttagcctcccgagttccgattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388969 - DNA, 2124 bp, Homo sapiens
ttatattccctatgaatacatggcagttctgagatctaaagttatcaacaatctgaaaaagcctttttctatattttaataatttctttataaaatattatttatcttgaatttggcaaattttagatgaaagcctatatgcttgtcgatgtttacatttctagtaaaagaacacttctgatcttttactgtaattctactctaaatgcctatattttaaaagttattattctcatatttaaggtaggtgaactttttttctagttgtaaatatttaagatatgatgaatttctcatggtacattattttccctcccatcccactacctgttttaaaatacagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388970 - DNA, 3500 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcagtaagaatctcttatttttctcattttaatctggatgaatcttgttagtaatttcttaaagcaaaacattgatatgatttttagtgtcatggtctttagattcattactggaatgcatcttatgacaattctctgattttaaaaaaattatggtattcttatttatttagaaatgcctattctttgcagttttcacattcataactgctcccatagtaattcaaaatgtccttagccatgtggtcagtgatccctcctaataatagatttagcaaatttcttcttttgatccattttcaatttggtactatggcctcttgttcggcagtttgtacgctttgttatccaggttttgttcctttttatttgctctctttttggtgatggtttcttcagaagttatgatgtttgcccatgtaaatacagggtttgcaggtgattgtcttaggccaccttgaaagtatggccatgaaaataactcttgtggcaagccaacaaaaagaaattgcattaacgctgcttccctgtccctaactagtccagttacgcttgggcattacaagagatcgcaggtcagtgtgtaatattatgtacctatgtgctgcagtttga

SEQ ID NO: 388971 - DNA, 678 bp, Homo sapiens
atccagctaatttttttaattaatattttttgtagagatggcctttcaccatgttgcccaggctggtctcaaactcctgagctcaagtgatcctcctgctttggcctcccaaagtgttagaattacaggcctgagccaccgtgctgggccttccctttactttttattttagatataattagatcttaaagtcttcatagaaggttgcatttcagtatgtagttttggtttgttaagaaatattaagaactatagtagctaggatgctatgtctgttctttagctttagaactgcttaatagcattattgttgccattaaactcattctttctgatagtttaaaatttagtactctcaaattgagtgtgccaaaccaaattcctaagcattttaatctctgatcacaaattgctttgcatttcttggttttctcagttaatatgttgatctgttatttttgcttgagtcattcagttatcttgtaaaaaccatgtttggttctctgtaaataactattggtaataagaacatgtcgttcttcagtaccctcatctccctacttgtaacaggctgaaagaagtcctagctgtaaaatatgttctgtaacataagagaatgatattttgcatcaattcttaggtgtgtcgtttggactggtgatgagcgggtcttctttt

SEQ ID NO: 388972 - DNA, 625 bp, Homo sapiens
tttgtagggtgtgaagtaggtggtaaatagatgatcagttcattatcttgactgtattattaagtgggggaaatatagaatagatgtaaagcatgattacattttagtgaaaatacttatgtcttaagagaagcacggaaataaaatatactacagattccataccattgatatttctttctaaaagggatttgggaagactgtgatttctcttccgcatttctaaatttcttgacatgtttataataatcatgtatttataatcgggaaaaaaattaaagaggctttttgctgttttcttttgttcttgaagcctaagtagagagctgtgtgcttgtgtaatatctcagtgaagctttaaagtgaaacttggtatagattatctgtgtataattatctacagttaatatatttttcctggtatagtttggacaaagacattgtccaataatttggtagttaaattacctatatgaaagattgacttgtcaaatttgttgatttttataataggtgtttgatcagtatgtaaagaccagggcagaggaagaacgcagggaaaagaaaaataaaataatgcaagccaaggaagatttcaaaaaaatgatggaagaagcaaaattta

SEQ ID NO: 388973 - DNA, 4141 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388974 - DNA, 4090 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388975 - DNA, 4596 bp, Homo sapiens
ggaacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatatatctgtattgtatatgattattgttacttaatttttaagagcttattttaatctgtttttaaaagaagcagcaaatagaatttcccacaaagtaagttgactctaaatcttaagtattacctagtttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttaaaaaaaaaatctttttattttatgccttcataggttgctcgtttcagagtgccacataaataaaatgtttaacaa

SEQ ID NO: 388976 - DNA, 2813 bp, Homo sapiens
gcaacagcctttttcttggctaatcttatcatatttaactaaatgccattttactgtccttttaagtacaaataacacttaacatttattgggtcattaaattgtggtgagtaatataagacgagtattaacattacagaatggcggactgcttgggataggtaaggtatatatgattattcttcctttaatatcttgagaatggcttttgttaaaggagaactgatactttgtgatattattatttgcaatttaattgagaagggatttcaactatttggttatattcacagattcatttgaataagtaaaattgttcaattttaaatcacaacattgttcacaagattggagcaagcatgagaaatcaaaatataaatcttcaaggctttttctgatgtactgatttttaaaatgtcacacagtagtagttattttaatgagtaattaagtgtctgttatttctatataatataggaatgttcagagccaattagtgtggaaatttgctattgctagcctcccactgcttgtcatttattagtgatggaaacttcagtatggttttatgtctcctttataaacagatatcctgtagatttcaagcaaaattatgacctttatatttttagaggagacttaattatgaggcaatacgtttttattttaaaggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388977 - DNA, 1718 bp, Homo sapiens
tcttcatgatccatatcgggaacaagtagtactgtaatgggttaggccaaatatcatctttgatggacctctcctaactcatcagcacctgcatcagaatggtcagtaaaccaggtaaagaagctctctggttcctcatgctgcctcttcctgctggctttattctgcgtttgactcgaacgtttcgtcaagtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagttaatttagtgaaagatgtgaaagtgaaagcttgtgaaagatgctgggattggcagccccgcagactgaagtcctctgttcatccacagaacagatccaaaaaattaatccaagaatcggatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatata

SEQ ID NO: 388978 - DNA, 282 bp, Homo sapiens
aattccacttggtcatggtgtacaattctttttatatatcactaaatactatttgctaatatttttaaaaggatttttgcatctatatttatgaaagatattcttttgtagttttcctttcttttcagtactgtttgtgtctgattttggtatcagggtaatattagctttataaaatgaattgggtagtgtttccttatcttctgttttctggaagagattgcatcgaatttatgttagttatctttacatgtttggtagaatttgtattgaaactatctg

SEQ ID NO: 388979 - DNA, 375 bp, Homo sapiens
agcaagagaaagtactgaacagttttctcaggtattatgttctaacgggcttgtcctagaaggggttaatatgttagattgttccatgacaccctctttgtacactgtcactactctgcttccctgcccagggcaggaggaatggcctagttggacccagggccctgtcactgcccaatgcacaccaacagtgttggagcactctgttcctcatccaaaggacaaaaagataaccagtccaagcacaaaggacaaagacaacagtttctaggcagtaactgacattcttagtgctaccatattttccttcttctctgttaaagaattctgctcgtgatttttaaaaggaaaagcccaggactgacacagcctttc

SEQ ID NO: 388980 - DNA, 299 bp, Homo sapiens
aacggaagtgtggcctcatgttttagagaatgccatcaattgtaaaaagaaataggaaactcatttttaatatgcctatttaaaaaaaatagatgtcatgactgaaggctttactcatccaaagctgaactattccttggtatataggtgtatagatcactgattcaaaacattcaagagttagaaagggatcttagaggtctcctagttgaacctgctctttcctagttgagggaacagaagctccaggattttcaatgattatttctggtcacaccactaattagtggcagaattgg

SEQ ID NO: 388981 - DNA, 663 bp, Homo sapiens
gtcacagtgaccgccaccgttgccaagggatgggtccctgagacttggcgaagtgggagccctgtgtgatcgtgcgtcagagtcggggctgagaccagccccggccagggcagttaccgggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagagattgtcctgcctcagcctcccgagtagctgggattacaggcacatgccaccacacccagctaatgtttgtatttttagtagacacagggtttcatcatgttgcccaggatggtctcaatttcctgacctcgtgatccgcacatctcggcctcccaaaatgctgggattacaggcatgagccaccagaaccggacatgctttccttaaaagctaaatattttaggcttgtgtgccattaggctctgttacaactacttaattctgcttttgtaattctatagcacccattgataatacataaacaaatgagcatgaatgtatctcagtaaaaatt

SEQ ID NO: 388982 - DNA, 349 bp, Homo sapiens
acgcccagctaatttttgtattttttagtagagacagggtttcaccatgtgggccaggctggtctcgaactcccagcctcaggtgatccacccacctcggcctcctaaagtgctgggattacaggcgtgagccaccatgcctggccaagccagtggactttcttaacaggaggccccctctctcctacctctcactgccgcaccagcttcatttctgcccgactctgctgggggtggggctgggggtaacagctgctgtcttggggaactggcctggttagcaatggtgggacccaggaaaagggctcccctgggcaggggggcaggtggtggctgcaggggacacacg

SEQ ID NO: 388983 - DNA, 1020 bp, Homo sapiens
ttctggtcatacttaatacagagagtcctgtattcctttttaaaggagaataagttataaatcatacttgtgggccgggtgtggtggctcacacctgtaatcctagcactttgggaggccgaggcgggtggattacctgaggtcaggagtttgagactagcctggccaacatggagaaaccccgtctctactaaaaatacaaaattagccaggcgtggtggtgcatgcctgtaatcccagctactcaggaagctgaggcacaggagaatcgcttgaacccgggaggcagaggtttcggtgagctgaggtcacgccattgcattccagcctgggcaacaagagtgaaactctgtctcaaaaaaaaattatatatatatatagtaatactttcggaaatcataaagattaaaaggaaaggaaattaatcggaattttgactataagcataaagatcgtctaatgcattatcagatttattcattctgactttgctttacagtctagcacttatgtacatgaaagctatttcatatcttggactctttcttattctagataagatttaatattctgaaacacttcaactaatcttcaactggtaatcattggaagtttttctttagtttttggatctcgctacataagcagctgttaagagtctcaccttgcaaataaactctcccaaagttctgactgacgaaacaggcactaaaccacagttgtgtaatttaagcctgaagcactggacctgtagtgcttttctttttcatagaacttgtcatttgtgttgtatatgctctttcctgtgactctgcagaaaacaggcagacttgtttccaatctaagcctgggcagaaatgtagtggtggtaattctcataatttttcatttttcatttccaagagaaatgttctagtttatatttatcacacatgccaaggatatagtagtaataaggtgactgggcctttagactcagaaaaacaatttctgaactggtcagaataggtttaagtgctt

SEQ ID NO: 388984 - DNA, 348 bp, Homo sapiens
atgaaatcaccatatgatatggtcttattttctaattctcctctcactgttttcttctaatcggattgtattgttgacatggataattttcaaattctgttcatggaaacttggtcagcatcaaataaattcttgttgatacttatcatcatccatttagataagtgtttgactgcagttactgctagtattaatcatatttggtattttatggatgttagttcaaagttttcagagtgatgtaattctagaagttacatcatcgcattcccatgaaaaagaaaatggagggaatgaggggctagtaatttttccaaggtcatacaggtaaaatgttcttatgctaat

SEQ ID NO: 388985 - DNA, 451 bp, Homo sapiens
gcctgtgaaataatttacattaataaataatttattaccataactcctaaagtaattatgggtttccatccaattttttttagcatatgaattgttttgttctgtccattgacttgtatttacaagacttttcctagtagcctttttaaaataattggtattgccttcgctttcttacatatgatgtgatttccaggtctcctcctcgcctgagtgctgaggaaaatggaatgtgtggtgtccattgtccctgcaatacaaatgcactgaatggctgcaattagccaagggtggtgaatggagactgcgctcactccacttgccctgtttcaccaaaaaagatcaaactagtacacgtgtgaccctgggtcccccactgcaagtgggagaagatgtggagggagccttgactgagagtccacgcgtggccccgcttctccccacacaggat

SEQ ID NO: 388986 - DNA, 434 bp, Homo sapiens
gtcaagaaaatggtcacagggaccaaatgtctaataatgaaccaactagttaaaatagttgtttataagttcctgtcaacttgagctttatggatgcgtgccataatttcccattgcgtgtgttgttaggatatatatacgcttttccggcaagcacaatgttaggttattttgatgcatttgtgtgaatggcacagtgagagcagttgctattaaaattacgtattagaatcaaccccagatagttcagcacagaaaagcaatggcatgattagtagtatcgtctttgaagatgaaagtgaactatttggtgaacctcccaacttgatatagaggagtttgactactttagcagagtttttctgtagttcatgtcactaaaagtgaggtagccataacaggggtttggggttagagagggtgaaaggataaat

SEQ ID NO: 388987 - DNA, 760 bp, Homo sapiens
agagcactgtaatcatatatcaatcgtattttaaagtgactttattatttaatgtcaagatgtacccttgatatgaagtagttttatttaataaagcagcaacagatcaagagcacttggtctagaggagtatgctgacaagtggcggcgcctgccttcttctcggggccagtcttcatctcagagctgtctagctttcaggtttgtcttcattgcttccagtctcacctaagcctcatgaatcctcagagacctatttcttaaggtgagtagaggagtgtttgtaatcatcactgtgacttgtttttgtgctaaaataccctttttatttttgagatgggggggtctcactattttgccccagttggtctcgaaatcctgagctcgagcaattgtcctacctcggtctctttattagccaggattacagatgcgtgccactgcgcctggctattagaagatgcactttttaaagaggtgaaggggagcagagtggaatagtggtattgtgacagttacctggaaaacttctaactcctcttcctaaatttacctcttacagagtgtcctgtattaggtagcctcagtttccttcccatgtaatgcatacatagttatttgttattattgcccttagcaggtaaggctgtattaagcaatttatgtgagagaagaaagggagatgacatgattggtggggagccagtttagttaagtttctttggacaaataggacttttgagaaatctgaaaagaataa

SEQ ID NO: 388988 - DNA, 313 bp, Homo sapiens
aagccaccgcacctggcccattacatttataatgttataagggggttgagggggcgtccactggagcagtggttctcaaactcgtgtatgcataggaattacctgaagggcttgttaaaacacaaactgcagggcccacccccagagtttctggttggggaggtgtgggctgggcttgaggatgtgaatctctcacaagctcccaggtgaggctgctggtctgtggacccacttcaagaccaagtgaatcagaagagtcagtgagactggaacaaatgaacgcaagacagtcttcaaaggaagaaccaagagg

SEQ ID NO: 388989 - DNA, 545 bp, Homo sapiens
aggcatatatttgcttcttttatgttttgtttgctgacttgattcttttgcttttgaccctgatggatgacttattaatttatgtatttaatttttgggagagttgagatagtagagtttccgatgaaaactggaaaacctgctagacaaattctaaaagaactgtaatactggattatcatttaaattagtgttatttttactgttttcaccaatgaatttttttaaactataaattaattttttataatggattcagttaatttaacaattcccctgtataattgtgaaaattaaaaatactgattaatgggaccaggcgcagtggctcacacatgtaatcccagcactttgggaggccaaggcgggtggatcacgaggtcaggagttcgagaccagcctgaccaacatggtgaaaccctgtcttactaaaaatacaaaaattagcagggcgtggtggtgcacgcctgtaatcctagctactcaggaggctgaggcaggagaatcacttgaacctgggatggggaggttgcagtgagaggatc

SEQ ID NO: 388990 - DNA, 547 bp, Homo sapiens
atagatgtatgcatatacatatatagtattgttttaaaacataaaaggtatattgtaggcttctttttgctgttcctgaaatagctcatgaaaaataaaagaaaatataaaatatcgtagacttcttttggcaacttgcatttttttactcaatgcatttttgaaaatgaggcatgttgacggacatttatttttactttacctttgaataatattccattatatgtatacactgaattttatttaagtactctatgtatggacattgtttccattttatactattataaataatattcaattatccccatacatgtcccttggcatacatctctgaaaatccccctttagtttatgtaactaaagcatatgttcattttcaactttaatagatattgccaatagctctccaaagtggaaacaggagtggtggctcatgcctgtaatcccagcattttggaaggctgaggcaagaggatcacttgagtccaggagttcaagaccagcctgagcaatgtagtgacaccccatctctaaagaaaaaaga

SEQ ID NO: 388991 - DNA, 386 bp, Homo sapiens
ttctagtgtggcccaacagcaacgctttgctaaaagaactccaactgtaccccagccaaccctacgaactcatccactcactttctcagcttcctgtggagtgaggctcagcaaccaggcccagtcctggccaaagaaccaagcagagaaacgaggaagatgtcacgcaaaactactgaggggctcctggggaagattttccttcctaattaaaggaagaggggcaccgaggggagtctctttggtcccaaccctgattctttccaggattaatgtttactctaagagggtgaggtctttatttgctttactcagagatgtatcacaatggcataacagatgctcattgaaaaaaatggaatgacaatgttttgggcgtacgggga

SEQ ID NO: 388992 - DNA, 312 bp, Homo sapiens
tcttcccaggtgcagctgtgtgtgcacgcccctagaccgctcccccgggggcctgattcacagcaatgatcaccagcacgtgaggaaagactggcgtaggggagagtggccagggttcccgccagagaggtgttgcaggagtccaggcgagaagcgatgcggcccaacagggcattagggtcaccagaaccccctgtctgggcacccatgcttctacctgcagagctggagttttgtttgcagaccttagtgtgggacttcacatttatccttattaaatctaggcatggtcagattgcacccaacactgca

SEQ ID NO: 388993 - DNA, 435 bp, Homo sapiens
tacttggcaacacaaagaaacatggaaatctcaactcacataggagaagagaatcaacagatgccgaaaatgagatggcacagatgccagagacaatgtagatgggaagcctgaatagcaagcaagacagggtcgatcctccctccctggggagaaggatgttccctcggcagtttcctgctctagggcagttgggtttatttcatgactctccctgcacattatctgcctcacagaaaaagaggcctggaacatgcatgtgaatctcctgctgcttggaaagcctcttccttggtggatagaataatctagagccctggcttcattatctagtaacaagcatagacaggtcagatcttgggtgtggtgatatattcagggtgcgatcaccttgagaatccatctagactataagataaccccacctttttctgg

SEQ ID NO: 388994 - DNA, 338 bp, Homo sapiens
tcagggcaacagcgacagagaaggggaaatgggcaggtgggtgaaagtcaggagggaggctgactctgcaggccgcggaaacagctcgctgcaggagtcccgctgcacaggcccgctgcgaggaccctgtgcctgtggcataccgagaggtgcctggggaacagcaggtgctcagccatgcagagtcaggagggtcaggcctccgaggagaacaagacggtgcctgggtgaggtcaagggacttgtagatctcaggtggccgggatacccaacggggacaccaagggcccaagcaggcctctgcacatccaagccaccaaccacagccccagggcccc

SEQ ID NO: 388995 - DNA, 101 bp, Homo sapiens
gtgtatctgtgtgcagtggtgcatccgttagggtgtgtgggaacatgaggttgtctttgagagtgttttcatgagggttatttgtaagggtgtgactgttg

SEQ ID NO: 388996 - DNA, 799 bp, Homo sapiens
gttcctgttgatgaaccctatttcacaggacccctgctaaggtgatttgaggggaaatgagaggaggctcaaataatcacccagcccctgccacttactgaaagtgtaggtccttgtgccccacaccatcagagtttctgcgttagcagatttgtggtttgcccagcagcctgggcgtgtgcatttctaatgggtgcctcaagtgatctgtttctgatttgtatttctattgtgaagagtcagcccagtactgcaggcctcttacctaagcagaatcccagtctggcatcaaagctttagaggacaagttgattcaggcagagaagaacttgggctatacaagcgctgttcttcagcattgaagtattttggaggcattagatagtttaaccctttctcagtcaaggaatatttacagaacatgatctctgggcattgtaactcctggtcttagtggggaatatagggaccccatgtctccatggggtgcacagaatgtctgtgagactgatggagtggagaacgccatcccccagcctctccagctactcgaggcattctgtagaacataagcccatagattgtgtgtgtgtgtgtgtgtgtgtgtgtgcatgcgcgcgcgtgcgcactggaggaacctaagaaactatttggtgcacttcctcttattttagagctcccaaagtgtagctccagaatcgtaaagggatatgctcagtctcacagccagcctgtggatctcagtcccaacactcacccttgtgctactgagtcagctctaagaaaatctgccaaaagt

SEQ ID NO: 388997 - DNA, 398 bp, Homo sapiens
tggaatacagaaatgttggctccttctcctgggacccatcaaactaatgtgctcctcacaatctaataagctcctgtgtccgctttttcatatatttcttcctccaaaagagtaacttgcagagctaagactctaacccaagcctacaggattctaaagcttttaccaccattgcctcccgggcaggattagattcatgggccagcaacccgtgcagtcacatagggccctgcacttagaagggccccagatttagaagtggcctgctcttaagaatgatacaatggactttggggacttagggggaaggatgagagggggacgaaggataaaagactacaaatagggtgcagtgtatactactcgagtgatgagtgcaccaaaatctcacaaatcac

SEQ ID NO: 388998 - DNA, 644 bp, Homo sapiens
cagtcttgaaacataattcaggagctttataactgcagaggcttgcagcccccaaacacgatgccccttaagtttggccgtgggtagacattctctcttagaactgtctcacatggagaataaccccattctggtataatcaaaatgtaactgggttgtagatatgcaaatgctttatgtaatgtttatttggaggaaaattaggcacaaaaatatgggtgtcatctccctgacacctttgtaagttggtgagattaggggctgcaaagtgaaggtatgaaggtgaattggaggctttgagagaaagtgtggggtccaacagtaatgaccaaggaatcatgccatctggcttgaagttatgcaccagctcagtgtgagactaaactgtgctatggctgccactcaagccaatggggccttaggctgaattactagaagtatagagctcagaacgtaggaggggaagagctgggtcctaccatagctggagcctaactttcagtttgagacaggcctgttttacttgttcttagtgggcttcttgggcaaaactaggattgatgcatgttagccacagggaagtagattcttgcattaataagaaagaattcctggctgattagaggtatgcagaaaaaaaaaaa

SEQ ID NO: 388999 - DNA, 170 bp, Homo sapiens
gatgaagtctactttaaacttctaaaatgcagggttatttaaactggcatctaaatccaagctggttttggttggtaattcctctaggacattttactaaatcttgatcttatctaaatgatgctatgtcatagatggactgtttatttgttttgtttgtaatccaggga

SEQ ID NO: 389000 - DNA, 455 bp, Homo sapiens
  misc_feature (127)..(127): n is a, c, g, or t
  misc_feature (147)..(147): n is a, c, g, or t
gcataaagttagacaaatagattagtgaaatagaatacagagatcagaaatagactcacacattgttgaccacattattttcaactaatttttcagaaatgcacaaaggtatttcagtggaaaaaanattaataaatcatactggancaattagttatccataaagtaacctggatctatacaactacaaaaattaactcaaaatggatcgttgatgtatttgtctcttctcatactgctacgcagaaatacccaagactgggtaatttataaagaaaagaggtttaattgactcacagttccacattgccggagaggcctcaggaaacttacgatcatggtggaaggcacctcttcacagggtgacaggagagagaattagtgcaaggagaaaagatgccagatgcttagaaaaccatcagatttcatgagaacttactcactatcatgagaac

SEQ ID NO: 389001 - DNA, 267 bp, Homo sapiens
ctccagtgataaccctccatgcttcattttaagtgttctactaaatcttccctgaatgtcttagaaatgtgcattcttttggtttcgtcttgttgcttctctgtgcttagaaggccctctcctaaggctatctaaatgttaaccatgcttcaagatccagttcaaatccctttttctccattagtcattctcttactactacttttaggaagattctttcatggccattgcgaataaactgcttctgaggatatctacctaatatat

SEQ ID NO: 389002 - DNA, 726 bp, Homo sapiens
aggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcccgcc

SEQ ID NO: 389003 - DNA, 237 bp, Homo sapiens
taataggtattaatttttcttatttcttgaacagaaaggcactatgtccccgttttgacacatattagctctagatccttgaacaaattatgaaacttctctgagtcttcaattcttcatctggaaaatggggataatgatagccctcagggttgatgtgtgtaataaacaatataatctatagaaaatctcctagcatctagagggatatagcaaatatgaactcacatgtgaggt

SEQ ID NO: 389004 - DNA, 442 bp, Homo sapiens
ttccgctgggtctgggggccctgcttcgttaaaaactctcatctcagtctctggcaggactgctgtgggacagggaaagcacccagccgtctgagaacaggtttcaggtgcggcgggggactcaggttagatagtgagatggacactctgcaatgtacctgctgccagaagccagagcaagcttaggagaaaataatcaaaactgccttttcataggaaaacacagagattcctcccagcctgctgagataggtacagctcagcctggaagcggatggctggagaagaccgccctgggtcactctgcttcctagagacgaactgcccagggccaccatcgccaaaacagagcataaataccctagatcactcaagattggccacaggccaggcacggtggctcacgcctgtaatcccagcactttgggaggccaaagtgggt

SEQ ID NO: 389005 - DNA, 354 bp, Homo sapiens
gcagccgccgcgcagccggctctctctgcgcctcgctccgactccggcgcgcaccaagcgggaacccgcgcccgagcccggcgggcgccgctgctgctcctctcggtccccggttcccggtccccgaacgcgccgcggcgaggctgcgcccggcagtggagccgctcggagctgctgggctttggcggccgctcgctgctccgtctggccggaggaccggcggggaaggaaggggaaagcggggacacacacactcgccgcggcgcgcgcgcactgcacactcgtagccgcgcgcccccgccaaggcgcgtccggagcgagtttggccccgcggctccagccccggcacctgcc

SEQ ID NO: 389006 - DNA, 760 bp, Homo sapiens
gccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcggctctatcagtacatggttggaggacataggcgctttcaaacaggaatgcatagggagaaacataaatcaccaagttatcaaatcaaagaaggagataccataaatgtggatgtgacttggccaggtgctactctagctttggctatgatctacttaaaaaccaataacagtgcttctaggaagcccagacacatggagaagttctgagtgttttggccgatagtcacagatgagattccagcaacagctgggatcacccatgagatgtgcgtgaggaaggctttgagatggtttcagccctagccaccactgacctaagagaccacaagaaagagaatcacctggccaaacccagcagaccttcagaattcagaaataaaataatt

SEQ ID NO: 389007 - DNA, 612 bp, Homo sapiens
tggcagaatttaacgaaatgcttctcttctatagccaggggtcagagggcagaagacaaggtgcaggactccagagaaggccaaatttccagcccagggaagtcccttctccaaagtcagggccccaaagggaagggtggggtccctgatatctgagatggactatctgaggagacactcttgagacattgaacccccagattctcctgtacctcctggcctgcagaagtgacccattgcctctgttggaagacagaggtcctcttttgcttaaagaccatgcagaaactaagggaagggaccttacaagataaggagttcctctctccagcatctgtccccacctcccctcctgaccaccaggctcaaagctggatcatatctcagcatgacctgaccaaggatgtgctttgcatgccagggaccaagagggattaacaagcagaggagtggtgggagcaagccagcagggaccagccgggtctagagaatgttcctagatgtggactctgaaggttctagatcaagggaggctgcatagtagctggagactggagagttaattagtacagaaagactccctaacccctaaaaaggccctgggaagattct

SEQ ID NO: 389008 - DNA, 1514 bp, Homo sapiens
  misc_feature (1510)..(1510): n is a, c, g, or t
  misc_feature (1512)..(1512): n is a, c, g, or t
  misc_feature (1514)..(1514): n is a, c, g, or t
cacaacggccatcaccacctctccgcaccctctgtctccttccttctcgggcctcacccctggccctcgctttcagtgcccagcccggaccgcagcactccagttccgccccaacccgggaaccctggactgaggctcccgtttctgtcctttctattgggcgcacttccgatggcgtcaggaatttcagccaataggagccagccaggaagtacctctctgagcggttggtgccgggtataaaagaaggccagcacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagttggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaananan

SEQ ID NO: 389009 - DNA, 1328 bp, Homo sapiens
  misc_feature (1324)..(1324): n is a, c, g, or t
  misc_feature (1326)..(1326): n is a, c, g, or t
  misc_feature (1328)..(1328): n is a, c, g, or t
cacaacggccatcaccacctctccgcaccctctgtctccttccttctcgggcctcacccctggccctcgctttcagtgcccagcccggaccgcagcactccagttccgccccaacccgggaaccctggactgaggctcccgtttctgtcctttctattgggcgcacttccgatggcgtcaggaatttcagccaataggagccagccaggaagtacctctctgagcggttggtgccgggtataaaagaaggccagcacggctgctcacgacgccgcggatcccgaagcctgtgtagcagtgagacatcagtgaggtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaananan

SEQ ID NO: 389010 - DNA, 393 bp, Homo sapiens
gggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggag

SEQ ID NO: 389011 - DNA, 635 bp, Homo sapiens
aggtggagccagaatgcagacattagccaacgggatgtggatacaaggtggaatgtggcgtccaaacctctgggtaaggattgtgaagatgccagacccataaaagaggatgatgatgcagacatgggagccaaatgtgttgagagctttgtggcaagcatctggagaaggcatgtggaagacagcatggagaatcagcatataggaaataaaaattagtacaacatctaagaccaccgtcgacattagaatggaaaacccataccaaatgtttattcgaatgtcattacatgcatatttggctaggccaatgtgttcacaaaaggtgtgtggaataatattattctggcagaaagtcaatctttttaaaagaaatatgatagggaaaattgtaccataacttctcagagagacagtcacacaaattttcttgatcagagcatttgtaagaatggtggtgtacctcagtgggtagcatatggcaatatagtggtcaaaggccatcaccagcaagatccctgactcagagatgaaggtggaatggatgaagaagagctgagtgatgcaacgatccagggagatgtccccagcacggaaccagaagatagctaaggcctgaggaatggtgcacgtgg

SEQ ID NO: 389012 - DNA, 269 bp, Homo sapiens
gaagattaattgcactactcgttggcagaagcatgactgatgatcaacacacgatgaaggagaaggaaatgagaaagaaagcaacgaagcaaaggaaaagaggaagcagtgcaggatggcagggcagttcttagtatgcacccagccatttcctagctctacctgctaactgggcctggacatgacaccatggtgacaatgaacacactaagcaaccggaccttggtctctaaataccattcccagtaaaggactccttggagaaatgg

SEQ ID NO: 389013 - DNA, 530 bp, Homo sapiens
tacagggtgtgaaggcaaacaagatgatctcttacaggggaagagagggcttaggacagcctccatgggggcaggtgagtcctgagttgggtgccaaagtatagagtaggagttcctagggaaataaggaaagccagtcacttcccaggggagaaatcagtatagtcacataactcagtgttctagacttcgtaaaccaacccagaggcatgatagcataagtttgactctttagtctgccattactgtgtgttcttaaacaagtcttctatgtctcggggtctgcatctgaaagatgaggataatagcagtacccacctcaaggggctgctgtgaagattacataagatgacctctaattaatcatacattaataaaaatgagtgcaaaattattttaaggcttttcaggagcaagggagtaggaatgctgattctgagatgaagaaaatgttttatacttctaaaatctcttgccaagatcattaagaagtaggagattgaagagaaagaaaggtggtgtgtaagcac

SEQ ID NO: 389014 - DNA, 5326 bp, Homo sapiens
ggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaaccccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgcatcaaagatgtgacattgcatcttttacaggtgattcaagggtgggggaggcaagatgcaggcaaagccaccgtttcactgggtggattcagtaggtcccccacccccagcagttcccgaaggtgctggggagatttttaaaacaccagtgacagaatctcacccccgtaagtgataaagcctgagcatcaggatgaagtctccgcagggggttctaatgtacagggtgaggatgcttcagttggcaacgggaagccattcaggtttctgatgggcttttcgggggcacgtggcagggaagagggtttgtgtcacttttagacaatcagcttctcaggggaaactgtctgcactgtgtataccagaagctccacaaatgtctcaggacatcgatgacagcccctcagtagaagacctccctgttctggcccttctgccttgcccccggaggttccagctgtagttgatgaagcaaaactttccaagccagaggaggtgttacagagatggggtttcgccacgttggccagactggtctcgaaatcctgacctcaggtgatccgcctgcctcggcctgccaggctgctgggattacaggtgtgagccaccatgcccggctgagaatttaatatttcattcgtatttttatattgatgacatgttgaaatgataaaaaaaaatttgataggttaaagtatattaaaattcatttcatctgcaaaaagtt

SEQ ID NO: 389015 - DNA, 2721 bp, Homo sapiens
ggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagtgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaaccccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgcatcaaagatgtgacattgcatcttttacaggtgattcaagggtgggggaggcaagatgcaggcaaagccaccgtttcactgggtggattcagtaggtcccccacccccagcagttcccgaaggtgctggggagatttttaaaacaccagtgacagaatctcacccccgtaagtgataaagcctgagcatcaggatgaagtctccgcagggggttctaatgtacagggtgaggatgcttcagttggcaacgggaagccattcaggtttctgatgggcttttcgggggcacgtggcagggaagagggtttgtgtcacttttagacaatcagcttctcaggggaaactgtctgcactgtgtataccagaagctccacaaatgtctcaggacatcgatgacagcccctcagtagaagacctccctgttctggcccttctgccttgcccccggaggttccagctgtagttgatgaagcaaaactttccaagccagaggaggtgttacagagatggggtttcgccacgttggccagactggtctcgaaatcctgacctcaggtgatccgcctgcctcggcctgccaggctgctgggattacaggtgtgagccaccatgcccggctgagaatttaatatttcattcgtatttttatattgatgacatgttgaaatgataaaaaaaaatttgataggttaaagtatattaaaattcatttcatctgcaaaaagtt

SEQ ID NO: 389016 - DNA, 565 bp, Homo sapiens
atggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggtgaggtgatggaggagcggagggtgggcagaaagtgggtgccagggagggacccctgatgggaggtgaggggcagaggagcctgtgacttcaggcggtgacttttcttctctgggcctcagtttccacacccttttctcacactccctgacactgcccctctggctgtggtggaaggagaggaagccacagaaaggcatcagctcccacaggggaaagccatccacaccgaggagagcctcgaggctgtgaggccactgtctcactgtgtggtctggtgctctgctaatgtccctaagccgcagctcgcttgtctgtaaagctgttttctgtgtcatagaattgttaatgaagcccaatgaataataatcacaaaagtccttataataacaaatataaacctcttggtgaatgacaaactgtta

SEQ ID NO: 389017 - DNA, 2173 bp, Homo sapiens
ccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccaaactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaacaggaatgacctaggtgttctgccaaaggagttatctatcatctctggcaaacttgacaatcatcacttacctcgacaaccctgccccacatcactttataaagtcagcaggatgtcctctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggca

SEQ ID NO: 389018 - DNA, 2018 bp, Homo sapiens
ccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccaaactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaacaggaatgacctaggtgttctgccaaaggagttatctatcatctctggcaaacttgacaatcatcacttacctcgacaaccctgccccacatcactttataaagtcagcaggatgtcctctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgctttccacctagacgtcgctttccacctag

SEQ ID NO: 389019 - DNA, 2497 bp, Homo sapiens
ccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccaaactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaacaggaatgacctaggtgttctgccaaaggagttatctatcatctctggcaaacttgacaatcatcacttacctcgacaaccctgccccacatcactttataaagtcagcaggatgtcctctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtattttc

SEQ ID NO: 389020 - DNA, 306 bp, Homo sapiens
cttgagtccttcttctgattggccacatgcccatagagtttgttaattcctttctctgcaccagtggttggcaaactttttctgtaaagggtcagacagtaaatgttaggttttgcaggccacgcagtctgttgccactattcaactctactattgtggcacaaaagcagctactggatgagtgtgactgggttccagtaaaactatttatgggcctggcatggtggctcacacctacaatcccagcactttgagaggccaaggcaggatgatcgcttgagcccaggagttcgagaccagtctggg

SEQ ID NO: 389021 - DNA, 213 bp, Homo sapiens
tgccaatggcatgagggctatactggccaactaggtctttgcttaaggttccaaagagtgcaaacactatagaaggtcaagtctccctcctattaaaagactttttttttctaacattttgaaatcttttgttacatgtttacacggaagtatttgaagaaatacaagggagtacaagcagtttttctaatgtttcataaagaaaaacaggtg

SEQ ID NO: 389022 - DNA, 382 bp, Homo sapiens
gtggaaggggaggcagcacactcagtgtaacttttactgaaaaaaatctgcaagtaagcagatctgagcaactcaaacccatgttgttcaagggtcaaccatgtaagcagaatggttgtggtagagcagaggaaaggtaagagaaagagtatttaaaacaatgagagcaatatatttccctcattgcttatcacttgcaattagaaaagcccagcagattgatttggttaaatattttgagtaagtttaagaatttttctttcaaattcaagagtttgtctgggcagatagtagaaaaaatataagataagtgaactcagagagcagtgcttcctctagattctgctgaggggtctccatcctggtgaatatttccttgaac

SEQ ID NO: 389023 - DNA, 393 bp, Homo sapiens
actataacttcatactaagtctttatatttggtaggacaagaattgctcaccttcttcttcacaagtgcgttgcctgtttcttattctttgttcttctattatggtttcgattcagtttgtccaattccaccaaaaaaagttgaaattttgtttggaattgcatagaatctatagataaatttgagggtaactgacatccttacagtattgttttctaatatgtgaatatggtgtgtctctgtttacatcccctttaatgtcttttaatcaatatttttttttttttttgagatggagtcatgctctgtcgcccaggttggagtgcaatggcatgatctcagctcactgcaacctctgcctcccaggttcaagtgattctcctgcctcagcct

SEQ ID NO: 389024 - DNA, 309 bp, Homo sapiens
agaaaaatcatattttctaatgatttccaccaaattattgcctttaaaggttaatacttagcctctttgcacaacctcaataatggaaatttttacctacctatttttaaaaattttattacttttttttattgaggcataatttaaactcaggaaaattgacaaatatcgtgtatttggtttgatgagtttgagggggaaatgaataaactagtactgacagttgttgaagtaggccaacccggaaaacatgaaatttaaaatattaaagacagtttttaggaaagattctttgtgactggcttcttg

SEQ ID NO: 389025 - DNA, 1650 bp, Homo sapiens
cctgaagctactggttggttccctgagaggtcccagaactctgcaaagtgagtccagcgctgagatttttcttgcagatccatcaggatgagcatccaggccccaccgagactactggagctggcggggcagagcctgctgagagaccaggccttgtccatctctgccatggaggagctgcccagggtgctctatctcccactcttcagggaggccttcagcaggagacacttccagactctgacggtgatggtgcaggcctggcctttcacctgcctccctctggtatcgctgatgaagacgcttcatctggagccattgaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagaggccatgagtaagaggcagacagcagaggactgtccaaggacgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccaattaaatatctcagaaagtcattgaaaataatatacattaatagtattggggagctggaaattcacaacacgtgctggccacatctgataagaaagctttattgttacctgaaggagatgaagactctttgcaaactcgttttctccaggtgccatcattacacgtcagataatgaactcgagggatggttagtcaccagattcacctctgtgttcctcaggctggaacacctccagttgcttaaaataaaattgatcaccttcttcagtgggcacctggaacagctgatcaggtgcctccagaaccccttggagaacttggaattaacttgtggcaacctattagaagaggacttgaagtgtctctcccagttcccaagcctcggttacctaaagcatctgaatctcagctacgtgctgctgttccgcatcagtcttgaacccctaggagctctgctagagaaaattgctgcctctctcgagaccctcgtgttagagggctgtcagatccactactcccaactcagtgccatcctgcctggcctgagctgctgctcccagctcaccaccttctactttggcagcaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaattcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtaggtgcaaactatttttctcttttcttatttatttcattttttaataattccaaaatgaattaaa

SEQ ID NO: 389026 - DNA, 270 bp, Homo sapiens
gaagaagtccaagaccatatgcagtctacagaggttccatctatggagcaaaagttgggagcagaccagcagggttggcagcgtgaagattctagttctctctgttgaagtctcaactgccgagccagcactcagacacagagaatggtggttcccaaaagttttgggaatccatattgtgaacaggctgacactctgcctacctactgtttaagggaatttagactgttttgggaaacaatcgtgtaagaaggcttgcctgtgctgcct

SEQ ID NO: 389027 - DNA, 1022 bp, Homo sapiens
cacagaagcagcttccctggagaacagcaagctcgtcagctgccacaacagctatgccaccaccctagcatggcctgggggctgccttgccatcagaacactgctggtgccaacccacacctcttcctggggtgctactcaacctccagcctacaggggctggagtatgggggccagcgtggagatgcccatgggaaacccggggtcctgcacggtgagcttgagcctcacgaccacacttcccgcctggagagacacgatctgcattctcagcttcccacttcggtacaagtcagacaccactggtgggaaggagctctcgacctagccaagaagaggcaacagcagacatccatcaacgtcttcacgaccattaagcagggttccaggtgtgaccgatggatggtgcttggagccatttctctcctctacaatcaagaggaggcacctgacgaccgacctctcagagcacgcagagaagtccgttcacagcaccttagctgggctttccctgggacggccgggcctggcctggtgtgtgctggggactcacagtgaccactgcaatcaagctcccagttgtggagcatcagatggacaatcccctctgagtgtcctgaaaactggtgcgaaggtcatttgtgtgagcgtgtgagaaagactgattgattgatagatggagaggccccaccaaggaacaatgcctatggctatttggagctgtcccccctcttactaggctgtatcccacacaaaacacgcacacagagccaggtgcttagggctacccatgcccaagcaagggagataccagcctggttccctgcctttgtgccaacccatacttgcacacacaagtgagttaacatttcaaaagggagggaattctctgaaaacattgaaaaccagattcctcctccaggcaaatgttgggaagcaacactctgtgggtctctggcatttctacacatcttgcaagtagacgcactaactgcccttttgttccagaatatctttccaag

SEQ ID NO: 389028 - DNA, 431 bp, Homo sapiens
gggacacagaaaggctttcagcaaggaaatgccatgttcagactttaatttttagatgactatttagagtgcagtatgaataaggtattgtaggtgccaaaagagctacagtgttagggatgtagttctgtgttcccagaatgaaatgataagagctttaggctaagcatatagtgaaaagggaggaaagtgaataaatttaagagctgtttaagtggtctattttgtcaagattccttggttacatgtaattcgaactttcaaatgagtgaaatgtgaggtgagaacagtattactagctcacaatttccaaccacagaaagaccagggatggcagtgacaagtcacggacacaagggcccagggccctctcaccgtctctctgtgcagtgggttccttgcctctgaatgcagtagaccagtccagtgtg

SEQ ID NO: 389029 - DNA, 413 bp, Homo sapiens
tccggaaagtgctgagaggaaatgtatctatactactgcgttctgtcctctgtatgacctttgtgtgatgacgtgcaaaatagatggtagagattgggataacaaatgatttgtggaacatcgtggtgataattttactgtcttaaaggtagaatccatgaacttggccttgccactatataggcttttgaattttgacaagccttggggggatgaaacctagaataagttatttatggcgttacgctttaatagggttgacacttaaaaccttgttttcataaatgctaccttttggttatgttgatctgatgaacagatactggctgtcattgaaagaaagttaaccgaatgttcagatacttattgggctcctggaacatggctgctctgtagcttcatgaatattcata

SEQ ID NO: 389030 - DNA, 629 bp, Homo sapiens
cggggtttcaccgtgttagccaggctggtcttgaactctggaccttgtgatctgcccatctcagcctcccaaagtgctgggataacacgtgtgagccactgcgcccagccttatctccttttttatacatgaatagcagcgtgctatatatatagtctttgctccatgcaattattttattttatttttttttttagaaaggttcttgttctgtcacccaggctggagtgcaatggtgcaatctcagctcactgcagcttcgacttcctggctcaagcaatcttcccatcttagcctcccaggtagctgggactacaggcacacatcactgcacccagctaaattttaattatttttttagggacaaagtctccttcactgtgttgcccaggatggtcttgaactcctgacctcaggtgatcctacttccttggcctcccaaagtgctgggattataggcatgggccattgcatctggcctcattgtttatttgtttgttttcaagatggggtctcactctgccacccaggctggagtgcagtggtgtaatcatggctcactgcagcctcaacctttcctgttaaaatcagcctgcaaagcctcgaaattctctcccaccttttgccat

SEQ ID NO: 389031 - DNA, 120 bp, Homo sapiens
aaactatgagaaatgatccaatgattcttgtgaacttcccttccctacttcctgccacccacgcctgctccactctgtgcagcctggagaaggtcctccacagggaagatggaaacaaac

SEQ ID NO: 389032 - DNA, 416 bp, Homo sapiens
acagaagaggcatctgagtaacagacatgtttcctttactcacctagcttcctttttctatcctttattgaattataataatagaataggtcttattatcaattaagtgatctttcttgttctcacaatgagagcagctgcatcaagtaagttttcgccttactaaaaactttcagatgtcttttggttttattattcaatttttgagatgtataattaaatccctgggaatgagtggatataatttagaaggcaattcagctctgtgaacttatacagatgtcactaaaatcatgtttgatggataatttcagaaacaatgaaagcatcattaactagagtaacttggaaaagcacaagtaaaagacactgttattttgacaatattgagttaaatagaggccacaggaaaaaaa

SEQ ID NO: 389033 - DNA, 373 bp, Homo sapiens
ggaaaattaatgccattgtaaaaaaaaagatctattaattttaaaaattcaagggcaaacactaataaaatagaagcaggatattttccactgccatgctactaaatagggggaaaaaaaaggaataggccaggcatggtggctcatgcctgtaatcccagcactttgggacgctgaggtggatagatcgcctgaggtcaggagttcaagaccagccttgccaacatgctgaaaccttgtctctactaaaaatacaaaaaattagccaggcatgatggtggttgcctgtaatctcagctactcgggaggctgaagcaggagaattgcttgaacctgggaggtggaggttgcagtgagccaagatcatgcaatt

SEQ ID NO: 389034 - DNA, 156 bp, Homo sapiens
cagaggttaacatgggtttaccattaaaaaggagtaattacaacaatgataataataacttatgaagccctttgtgtgtcctgggcacagggctaaatgctttccttgtattgttgcactgaatcttcacaacttccccatgagtaagcattctta

SEQ ID NO: 389035 - DNA, 347 bp, Homo sapiens
ggtcacctgaggaggagaaaatgttaagtatgagagagaagaccgaggacaatgccagagggaatgccacagtttagaaatcatggagatgagaaggaatcagcaaaaaagattgagaaggagtaggcagtgaaataggagaacctagagagtggtgtcgccaagactaagggaaagacgtgtttcaggaaagaggaagtgatcagctgtatcgaatactgcagagaaattgaggaagatgagtacttagaattggttattgcatttggctagggacatgttatcagtagcctatctcacagtgttgagagagttccccatggatgttgttaaaaactctgttttga

SEQ ID NO: 389036 - DNA, 585 bp, Homo sapiens
aaaggaaaggaaaggggaaagggaaaggaaagggaaggaagtttctgctgtgctgaaatacatacattatatcccagccctgctttctccctagatgtttagtgtcacagatttctaggaagttctccttgatgtgactttcctcgctgtgctgcagtttcaagtctttttcttttactatattccttaatgtatcctggaaagagtctgttcacacccacccacctaaggctcttaacaaaaagactgtacttatattttggatcctgattttaaaaatcataagacatttttccagatattcatgaaattttatatggactgagtttgataattttgtctagcatgaaatgacattgtgcttatgcaagaaaatactcatacattttaaatttgtagggttaaaataacacgatgtctgggatttgcttttacatactttagccaaaacaaaaacaaaaacaacaactagtaaggataaacaaagcaaatgtggcaaggtgttgatagttgttggacctgggtggggcagatggaggtccagcatatccttataaatactcagacctctcttggtcagttaca

SEQ ID NO: 389037 - DNA, 286 bp, Homo sapiens
tttttgtcatatcgtaataaaatgaaggcaaagagctcctacaatcaatgagataaaccacaatcaaatagaataaatgacaaaaaataaacagttcacacacaaaaatcactcttaaatatgtatctacaaaaatactacttaaattctgaaaggccaccaattttctcttatattaacaaaggcccaccaagtcttaacaatatcccatgcagcaagactcctattctgttaattggtacagtctctatagagggcaactaaaaaaacatttctttgaccaagc

SEQ ID NO: 389038 - DNA, 404 bp, Homo sapiens
ggggaatagatagtgttaggagagctaattttgtaaacccaagcttttataaaagtgacattgaagttatgttagatatggaaattggcacatctgacccagacactgcaaccctgcaaggggagaacctctgcccctggtgcccgggagaggcccagggacacagggaaccacaatcactacatcaatgcactgatgatgagcacacagcaacacacactcacacaggatgctgttaacagcaacacacacactccatgcctgcacaggcacatgcatacacgtgtgttacaccaacacatgcagagtcacactcaagcaggagtcacaacccacactcactgtgtttgtccagagcctgggatccccaagaaatggacagaccttaaggagctcctctgacc

SEQ ID NO: 389039 - DNA, 1072 bp, Homo sapiens
agtctgacaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgccaatcaagaatgtcctcaaaatttgctcagaggtgtgggcctttgggtaaaggtgtcttcagaagctccacattaaagatccatcagtggttaagggcaaattgaagagaaataaagactaagatatttttttaaaagactgaaagaatagaacaatgaaaaagccccatctgtaatacggtttttctttttctttttttttgagacaaggtctctctctgtcacccaggctggagtagagtggcattatcctggctcattgcaatctgggcctcctggtttcaagtgattctggtgtctcagccacctgagtagtcaggattacaggtgcacaccaccacgcatggctaaatttttgtatttttagtagagatggggtttcaccatgttgagcaagctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggca

SEQ ID NO: 389040 - DNA, 1018 bp, Homo sapiens
agtctgacaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgccaatcaagaatgtcctcaaaatttgctcagaggtgtgggcctttgggtaaaggtgtcttcagaagctccacattaaagatccatcagtggttaagggcaaattgaagagaaataaagactaagatatttttttaaaagactgaaagaatagaacaatgatctctctgtcacccaggctggagtagagtggcattatcctggctcattgcaatctgggcctcctggtttcaagtgattctggtgtctcagccacctgagtagtcaggattacaggtgcacaccaccacgcatggctaaatttttgtatttttagtagagatggggtttcaccatgttgagcaagctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggca

SEQ ID NO: 389041 - DNA, 1200 bp, Homo sapiens
agtctgacaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgccaatcaagaatgtcctcaaaatttgctcagaggtgtgggcctttgggtaaaggtgtcttcagaagctccacattaaagatccatcagtggttaagggcaaattgaagagaaataaagactaagatatttttttaaaagactgaaagaatagaacaatgaaaaagccccatctgtaatacggtttttctttttctttttttttgagacaaggtctctctctgtcacccaggctggagtagagtggcattatcctggctcattgcaatctgggcctcctggtttcaagtgattctggtgtctcagccacctgagtagtcaggattacaggtgcacaccaccacgcatggctaaatttttgtatttttagtagagatggggtttcaccatgttgagcaagctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggcaaccaagatttctgtacatgtgtcatagaaatagttgaacttttccacaactgtatactgacaaacattattctttcttaattaattcagtagctatattaaaatatgtattagatcaagttcataatg

SEQ ID NO: 389042 - DNA, 1813 bp, Homo sapiens
  misc_feature (156)..(156): n is a, c, g, or t
ctgctttgtttacccaagcaagcctgggcaatggcgggcgcccctcccccagccttgctgcggccttgcagtttgatctcagactgctgtgctagcaatcagcgagactccgtgggcgtaggaccctcctagccaggtgcaagatataacctcgcnggtgcgccgttttttaagccggtccgaaagcgcaatattcgggtgggagagacccgattttccagtgagatgaacccagtacctcagatggaaatgcagaaatcacccggtcttcttgcgtcgctcacgctgggagctgtagaccggagctgttgctattcggccatcttggctcctctcctgcactgcaagaatggactaatacgctatgtgaagacaaaggggatgtctgcaagccaggacgagtgcgttaccagaaactgagttctgctggactttgatctaggacatccagcctccagaatggaatgtgccatatgtggagacctgcatggaaaggaactgaggatgctctctcactaaaagctagaaggaactgaggccctcagtcaacagtctacaagacactgaatcttgccagcagccaagcagtgagcttgaaagcagatctatcatcagctgaaccttcagatgagaccgcagcctaagcagataccttggttgcagccatgtgagacaacctgaaacagagggcacagctaagcctcagccaggttcatgaccctctgaggaaactgtgagaaagcaaatgtcattttaagctatttaattttggaggtagtttattacacaacaataaataactattataattatcttgaggatttatttcctggggagaatacatggaattgcatatataggtcctcatatgcagaatactggtaccctagagatgttcaccccagagatgttttaggaacctgtgaatatgttacattaaatggcaaagttttcctggatggtttaagtttaagatggaaaagttttactggattatccagtgggtccaatctagtaacatgagtccttaaaaatggagaatattttttggccatgatcagagagacatgtgatgatggaaaaagtgtcagagatgcaatgtgaggggactaaaactgctgttgctgactttaaagatggagagaggggaacccgagtcaaggaatgcaaatggcctctggaagctggaaaaagcaagaaatggattctcctttagagcctgtggaataaaatgcagtcatgctgacaccttgattttacctcagtgagaccaatactggagtatgaccttcggagctgaataaaattatacgtacacatcttaatttcttgggatttgattacttcttctgctttgaaattagaccaagtttagcctgcctttgctattttggcgtatctccaattcttcatgattttctcatagtgtgctcatatgatgcaaatatccacctagccctgacatgaaacttaattgaaagtatccaacagtggcgcaaaggccacataaggacagtgagaaggcagccacctgcaagccaggaagaaaggtctcaccagataccaaccctgccagcatgttgatcttggacttccagcctccaaaactggccttctgctcacatgggcttccgtgcacctgcttcaggagacagcaacacttgcgcccgcaccgcggcaggctcccatcacctggtggatatgccgcgccgagtctcatcacaccttagtgaaggaacacatggacccatatgttagcggatgtatttacatcgttttatacagaaaggggaagtatgtttcacaataaatg

SEQ ID NO: 389043 - DNA, 1429 bp, Homo sapiens
tcttgttgatgtagtaacttacttttaactaatagaatatggcaaaagtgaaggaatggcactcttgaggttagattttaaaagaccatgacaaccaccttcctgacaccttttctctctctctctctgcttactcactctgatgaaggaatgtgccatatgtggagacctgcatggaaaggaactgaggatgctctctcactaaaagctagaaggaactgaggccctcagtcaacagtctacaagacactgaatcttgccagcagccaagcagtgagcttgaaagcagatctatcatcagctgaaccttcagatgagaccgcagcctaagcagataccttggttgcagccatgtgagacaacctgaaacagagggcacagctaagcctcagccaggttcatgaccctctgaggaaactgtgagaaagcaaatgtcattttaagctatttaattttggaggtagtttattacacaacaataaataactattataattatcttgaggatttatttcctggggagaatacatggaattgcatatataggtcctcatatgcagaatactggtaccctagagatgttcaccccagagatgttttaggaacctgtgaatatgttacattaaatggcaaagttttcctggatggtttaagtttaagatggaaaagttttactggattatccagtgggtccaatctagtaacatgagtccttaaaaatggagaatattttttggccatgatcagagagacatgtgatgatggaaaaagtgtcagagatgcaatgtgaggggactaaaactgctgttgctgactttaaagatggagagaggggaacccgagtcaaggaatgcaaatggcctctggaagctggaaaaagcaagaaatggattctcctttagagcctgtggaataaaatgcagtcatgctgacaccttgattttacctcagtgagaccaatactggagtatgaccttcggagctgaataaaattatacgtacacatcttaatttcttgggatttgattacttcttctgctttgaaattagaccaagtttagcctgcctttgctattttggcgtatctccaattcttcatgattttctcatcgcaaaggccacataaggacagtgagaaggcagccacctgcaagccaggaagaaaggtctcaccagataccaaccctgccagcatgttgatcttggacttccagcctccaaaactggccttctgctcacatgggcttccgtgcacctgcttcaggagacagcaacacttgcgcccgcaccgcggcaggctcccatcacctggtggatatgccgcgccgagtctcatcacaccttagtgaaggaacacatggacccatatgttagcggatgtatttacatcgttttatacagaaaggggaagtatgtttcacaataaatg

SEQ ID NO: 389044 - DNA, 577 bp, Homo sapiens
taaggaatccatacatacctacttattttagattttattttattattattattattattatttgagacagagtctcattctgtattttagattttaaaaaatgcacacttgtggccaggcaccatggttcacctgtaatcccagcactttgggaggccgaggtgggcggatcacttgaggtcaggagtttgagaccagcctggccaacgtggtgaaaccccatctctacaaaaattagctgggcatggtggcgggcacctataatcccagctactcgggaggttgaggcagaagaatcgcttgaacctaggaggcggaggttgtagtgagccgagatcacaccactgcactgcctgggtgaaagagcaagactccgtcgcaagaaaaaagaagtgcatgttctaattctccaaagttgtttacacttgcccagatagaccctaaatcagctctgtttaatactcatgcctcattaatgcacttttaatgaactttgaattataaaagcagcgtatgtttggtagagaatttttttaagatgcaataaaagaagacaattattcgtaattccttcacc

SEQ ID NO: 389045 - DNA, 794 bp, Homo sapiens
gctgatgtggcctgctcttatgaggggcagtcagtagggccaatggacagtggggacagggaggtcgctttggcagcatctgcctggcactgcccagggagggggtctccagcagccaacatgaccatcctgcctgctgggggagcatgtcctggggtggtgctggcagccatctgcccagcccaacatttattagtagtgatcgtgtgttccaccctggaagcgctcccagtgcactggggaagtcacgtgccctcgcactgggtgatatgaggtttgataggaggagctctaagtgggtggaggaactcctaatactgctttgaggctcaaggaagtcttctcagaaggtctttagactaggtcttgagggaggcctaggagttcactaggaaagactttccagagaaggtgaaattgggttgggtcttgagggatacaaaaagttcactcagaaaacaagagaggaaacaccttttctggacactgggttctctttaggggctcatgtaggccatcagaccagtaagaccacagtattccgggaccctgctcacccatgccagcctctcctgtacgccctgtgtgtgaccgtatgggtgagggcccctccactgccccatcctagagcggttgggattgtgccagtgtggagtgtgctcggcacacagcaagtgcttggtcggagtgggctctcagaatcgtgcagctggtccgaggtggggccatgtctagggtctgcagcttgcatactcgtgacaggcactcaccctgctgcaggcagcccttccttc

SEQ ID NO: 389046 - DNA, 534 bp, Homo sapiens
  misc_feature (136)..(136): n is a, c, g, or t
  misc_feature (532)..(532): n is a, c, g, or t
taagtatcctgtggagagttactctactaaaaatacaaaaattagctgggtgtggtagctcacacttgtgatcccagctacttgggaggctgagacaggagaatctcttgaacctttgcctcccagtctcaagcanttccactgcctcaacctcccaagtagctgggattacatgtgtgcaccaccatgtttttgttttttcagtagagacagggtttcaccatgttggccagactggtctcgaactcctaatctcaggtgatcggcccacttcggcctcccaaagtgccaggattacaggcgtgagccaccaaaccctgccaaatatcctgtttctcatgaaactttcaccttctggttttatagccaaagtctaagcagaagcccctgcgaccattccaacactgacagaacattcctctgccttgttttacagatacattggggaaacttaaggatgagaactttagaaatggtatttcttggaaacccacttgcttgtaaatcagtggttgaaagaaaagaaaaaaanaa

SEQ ID NO: 389047 - DNA, 190 bp, Homo sapiens
  misc_feature (27)..(27): n is a, c, g, or t
tgcgaggtcgctctagacggatccctncgtaatatgtaccaaaaaccactgtactccaaagctattgaaataaaaatatattaaatttaaaaacttataaataaaaatatataggtcatataactttattattttcatgagtaaaggcaaaataaatgtttatgttgaatatcaatgattaatttgttga

SEQ ID NO: 389048 - DNA, 618 bp, Homo sapiens
cctcccaaagtgctgggaatacagccatcagccaccgtgcccaaccagttttttctttaatgattgtatagagataacagtactataataaataagttaaatgttagaaacatcaacataaactaaacaaagataatttctgaccatccataactttttctagttggcactgttttgattgcccaagagtacttagtggaaggctgcttgctgttccaactaaaacaatatttcaaggatatgaaaaagtgtgtaaattgagtttcacttaaattatttcacaataaaagtgattcataaaagttgattagtccgggcatggtggttcacgcctgtaatcccagcactttgggaggcagaggtgggcagatcccttgagtccaggagttctagaccagcctgggcaacgtggtgaaaccatctctacaaatacaaaaaaattagccaggtgtgctggtgcatgcctgtggtcccagctatttgagagggtgaggtgggaagatcacctaagcctgggactcggaggttgcagtgacagtgagccgcgatcgtgccactgcactccagcctgggtgacagagtgaaaccctgtctaaaaataaaaatttaaaaaagaaa

SEQ ID NO: 389049 - DNA, 435 bp, Homo sapiens
  misc_feature (27)..(27): n is a, c, g, or t
tcgatctagaggatcggtcgacggggnatttttaaataatgaaagataactcaggatgaactggaaaatcttccaaaaatctgacacaagagccaaaacagattaatgccatggcaaaaatgggaaaagttcccaaaaatctactataaaaaaggcaccagttccaagatggtttttcaaaaaacttttataagcctaaatttcttatattcttcaaatggttctagagcagagaaattataatagaattttaacattcactgagtatttaatatgtgccaggcactacgctaaacaatttatatgtacagttggccctcagtatctgcaggttacgcacccgtggattcaacaaatcttggatcaaaaatattcaggcggaaaaaaatcaattaaaaaagtaccacaataaaaaaatatacaaattcaaaaata

SEQ ID NO: 389050 - DNA, 416 bp, Homo sapiens
gcaatctaaggaaagactaaaagtacagtactttgaaaagactgctaaaccacaaatatacaacatcagaaataaaaaaagggggtatagttacaggcatataggagatttttaaataatgaaagataactcaggatgaactggaaaatcttccaaaaatctgacacaagagccaaaacagattaatgccatggcaaaaatgggaaaagttcccaaaaatctactataaaaaaggcaccagttccaagatggtttttcaaaaaacttttataagcctaaatttcttatattcttcaaatggttctagagcagagaaattataatagaattttaacattcactgagtatttaatatgtgccaggcactacgctaaacaatttatatgtacagttggccctcagtatctgcaggttac

SEQ ID NO: 389051 - DNA, 398 bp, Homo sapiens
ctttgcagcaacatggaaggcactggagacctttatccttaagaaactaaagcaggaacagaaaaccaaatgcctcatgttctcacttataagcaggagctaaataaaaagaacacatggtcacaaagaggggaataacagatgctagggcctgcttgagggtggaagatgggagaagtgagaggatcagaaaaaatacctttcagacactatgcttaatacctgggtgatgacataatctgtacaccaaaccctcatgacatgagtatacctatataacaaacctgcccatatactcctgaacctaaaagttaaaagaaaacaaacaaacaaaaaatgaaaacaaagcaaaacaaaaggtgtgagactctatagcttttcaacaatgagagtgggaa

SEQ ID NO: 389052 - DNA, 673 bp, Homo sapiens
gaggaagcagcagggatacggtttggatgttttcccttctaaccctcatgttgaactataatccccaatgttggaggtagggcctggtgggaggtgactgggtcatgggatgggtccctcatggcttggtgctatcctcgtgatagtaagttctcgtgagatctggttatttaaaagtgcgtggcatctcggccgggcgtggaggctcacgcctgtaatcccagcactctggaaggccgaggcaggcagatgacttgaggtcaagagttcgagaccagcctggccaacatggtgaaaccttgtctctactaaaaagacaaaaaaaaattagctgggtatgctggtgcgcgcctgtagtcccagctactcagggaggctgaggcaggagaagcgattgaacccaggaggtgaaggttgcagtgagccaagattgcgccactgcactccagcctgggcaacagagggagactccatttcaaaaaaaaaaaaagtgtgtggcacctcccccgactgtctcttgctcctactttcaccatgtgatgtgcctgctcctgctttgccttctactatgagtaaaagctctctgaggcctccccagaagctgagcaaatgccaatgccatgcttacacagcctgtagagccaggaagcaattaaatctcttttctttataa

SEQ ID NO: 389053 - DNA, 251 bp, Homo sapiens
tcagacaaatggtgatgctcttggtggggatatcagtggggggccaggcactcggcgacacagctttcatttgggcagccttccttgattaagaataggcctctttggagtgttctagctttgaacaagccagcctccctgcaagcagaagattacaaactgcagagatgtcagtagcaccaaacccgcagtgagttctagttttcagggctgtgttcagactggaagatgggaattatctgtgttctgtt

SEQ ID NO: 389054 - DNA, 505 bp, Homo sapiens
  misc_feature (59)..(59): n is a, c, g, or t
  misc_feature (69)..(69): n is a, c, g, or t
cgcactccagcctgggtgcaagagcgaaactctgtctcaaaaaaaaaaaaggaagtggnatatttggtnaattgataaattaccactgtcaaattatattggtgagtctatatctattgttgtccccagatgttgcctttgcaagaattagtgtaaaattggaaaaaatactcaatgttgaaagctgtcattgttgagatctttatgaaattattgtgcccatgtccaagtttgaattagagatacacagcacacaatcatttctgttaccacttttggaatatctagcattagccttgatagttttgtgtggtgtgttttgagtatatctgaactgttagttatatttggttaatttattaaaagatgtgtgttaaaccttaatatttatgcagtgtttaagtatttggaatatatttgaaataaattatccagtgttttagataaatggttatttaattgcttaaagtgattctctaaaaaataaaacattaatgaaatatct

SEQ ID NO: 389055 - DNA, 811 bp, Homo sapiens
taaagcataaggcctggtgcagtggctcatgcctgtaatcccaacattttaggagcccaaggccggaggatcacttgagcacaggagttcgaggctgcaggctgcagtaagctatgattgtgccactgcattccagcctaggcaaccaagtgagaccctgtctctaaaagtgaacaaacaaataaatgtaaagcataaagctataatttttagaagataacattggaaaaaatcctcaggacctaaggttcagtgaaaggtttttaagacataaccccaaaagtaccattcataaatggaaaaattgatgttagacttcatcaaaatttaaaattcatgttctctgaaagaccttggtaagaggataaaaagacaagctacagactgggtgaaaatatttataaactacatattcagctaagggctagcatctagaatatataaagaaccctcaaaattcaacagttaaaaaaagttagaaaatgggcaaaaaacataaagagacatttcactaaagaagatagatgacagataagcacataaaaagatattcaacaatgcatctcagaatgttcctccaaatttgaaaaaaaaaaaaaaaaaaagatattcaacatcattagccattagggaaatgcaaattaagatcatgatcagctggattacaggcacgagccaccacgcccagcctgtaggtcttttgtgggctatcctctttggctattctgggactttgtgattctatataaattttaggattatttttctatttctatgaagaatgttattgttactttgatagggattgcat

SEQ ID NO: 389056 - DNA, 403 bp, Homo sapiens
tccctagttcttttcaggacacgataaggctgagttgatgagaacatattaaagtcttgaggataaagccagccaaacccaaggaacagcttacacctgataccaggtgggtttggactcacaacctcagatctacacctaaacttcagagtctccttttctgctagttcttagctcggttccatcttttccctgccatagggaataaatcaagcctgtgcatgcttgagcacctagacccaaatggtttgccctatttctaggcttaaaaaacaaacaaacaaacaaacaaacaaacaacatctctggattacttcctcccaggatggctgccagtgggaaattcattttcctccagaagagatttcacagtgtggcttggctccctgtctctgaatatgta

SEQ ID NO: 389057 - DNA, 426 bp, Homo sapiens
attttttgtagagacagagtctcgctgtattgcccaggctggtctcagactcaagtggtccttctgccttggtcttccaaagtgctgggattacaggcttaaaccacagtgcccaacctataaaacttttaaatatttttcacctattcaccctttctaacattctttcttcttgccacctgtatgccacaaatataagaatgaaataggccaggtgcagtggctcatgcctgtaatcccagcactttgggaggctgaggtgggtggatcgcctgaggtcaggagttcgagaccagtctggccaacatggtgaaaccctgtctttacttaaaaaaaatacaaaaattagccaggtgtgatggcaggcacctatgtataatcctagctactcagtaggctgaggcaggagaatagcttgaacctggg

SEQ ID NO: 389058 - DNA, 248 bp, Homo sapiens
attttttgtagagacagagtctcgctgtattgcccaggctggtctcagactcaagtggtccttctgccttggtcttccaaagtgctgggattacaggcttaaaccacagtgcccaacctataaaacttttaaatatttttcacctattcaccctttctaacattctttcttcttgccacctgtatggactctcggcgtgtgcacttcgtccatagtgatctgaagtatatggaggctcggcgtgtgca

SEQ ID NO: 389059 - DNA, 449 bp, Homo sapiens
atttgcctgcctggaaaattcagacctgctgtcgctcttcggaagctgtagaaagaagaggacttaggagtccctgcattgaagagtggaaaggtttaattatccctgtctcagcttgtcacttcatttgtctctgtgttttgtgtcccctgttcaggggccttaggttttgttgtcctagaataagcatctagtcttttgtggctagagggggcagtgatctcaagggcagagaaggggactgagcatctaactacatacttcttaaatagactttccatcccttctctcattttttgtaaatccctacctttacttcatgaggacccagtttttgggtctgtgggacagtactgcagtgtagcaaatctggctacttcttgactttcgccaacttagagttaatttttattgtgtctcattaaccttcttttaaacccttataattt

SEQ ID NO: 389060 - DNA, 133 bp, Homo sapiens
cagtgtgaggacatagcaaggaggaagctgtctgcaagcccagaagagacccctcaccacaccatgctggcatcctaacctcaaacttccagactccagaacgttggaaaaaaaattcctgtcattacatcca

SEQ ID NO: 389061 - DNA, 409 bp, Homo sapiens
gcatgccaccatgcttggctaatttttgtatttttagtagagacagggtttcaccatgttggccagcctggtctcgaactcctgacctcaggcgatccacccgtctcagcctcccaaagtgctgggattacaggcgtgagccactgtgcccggcctcaatcccaattttcaacaatttcttttatattattctgcgctccactgccaccctggtctacacctgcaattatattttcacagggttctaccaggagcaatgtcaataactaatcttttcattatctcacctctgttatccttgaatgccaccccaatgtagttccctcaattatttatcttttcctatcctctttttttttttttaatacagagtctcactctgttgcttaggcttaggctggagtgcggt

SEQ ID NO: 389062 - DNA, 468 bp, Homo sapiens
ctttaaccagaggaatttcactttcctgactttcacaggagattgcattgtggttttttttgttttttttttttttgtttttttttgttttgttttgttttgagatggagtcttgctctgttacccaggctggagtgcagtggctgggtctcagctcactgcaacctccttcttctaggttcaaacgattctctcacctcaacctctcaggtagctgggattacaggcatgcaccaccatgcccagctaatttttgtattttttttagcagagacggggtttcatcatgttggctaggctggtctcgaactcctgaccacagatgatctgcccgccttggcctttcttttttttgtttgcgttttttttgttgttttgttttgttttttgagacagagtctcgctctgtcaccaggctggagtgcagtggcacgatttctgctcactgcaatccctgcctcccaggtt

SEQ ID NO: 389063 - DNA, 215 bp, Homo sapiens
atggagtcttgttatgttgctcaggctggcctcaagcaagtcctccatctcagccttccgatctttccttttttatattaaaacagtaatttccaccctgagaaataaagttttattacacaagaatgttaggagaaaacaaggcagggacaggttgacacaactataaagaatgagtcaaagagattgggcgtacggggattgggcgtacgggg

SEQ ID NO: 389064 - DNA, 233 bp, Homo sapiens
gctcctgagtagctaggattacaggcattcaccacacgcccggctaatttttgtatttttagtagagatgggtttcaccatgttggccaggctggtctcaaactcctgaccttgtgatctgcctgcctcggcctcccaaagtgctgggattacaggcgtgagccaccgcacctggccacatatgctaatttttagagacattgaatatagtcaaaagcaaaacaagaagatac

SEQ ID NO: 389065 - DNA, 407 bp, Homo sapiens
gttggcttggtttaaagaaggaacttgacctactgccttcttcctgttttcccttgcagtggcctccagggccactgtctctgggcctctccccaaacccctaccactatgttatcaccaccctgagagtccaggcccttgggtggcccacaattgctcaccatgcctggcctttctccagccctctctctccttgcctgctgagaagctccttcttataggaagctgctctcaggtagggagtagccacactcaggcataatacttcctaaagaatttaagtgcagatgtccaatcttccggagaggtccaatcttccggagaggaccaatcttccggagaggtccaatcttccggggaggaccaatcttccggagaggtccaatcttccggagaggaccaatctt

SEQ ID NO: 389066 - DNA, 239 bp, Homo sapiens
aaaatttcatctttaccagggtcctaagtattaataagaaataaattttaaattacttttgtaggttagaaatacttatttttttttcccctgagacagagtcttgctctgtcacccagagctggagtgcaatggcttgatctcggctcactgcaacctccgcctcccgggttcaagcaattctcctgcctcagcctcctgagtaggtgggactacaggtgtgtgctaccatgcctggc

SEQ ID NO: 389067 - DNA, 223 bp, Homo sapiens
ggctgaggcagaagaatcacttgaacctgggaggcagaggtttcagtgagcagagatcgtgccactgagcgacatgcctgagtgacagagcaagactctgtctcaaaaaataaaaataaaataaataaaaatggttaagatggtagatttaatgttacatgtattttaccacaatttaaaaagaaaatcataacatttttacaaaactgatattttgtggaaa

SEQ ID NO: 389068 - DNA, 581 bp, Homo sapiens
agcagctcattttgcaaatggagttctctttttttatatataaaccattttcttaaagcagctttcttcagctctcttaaacgttgtacacacttagtagtgcctacatcaacactgacacaaccctgtataaggaacacctaatatactcattcagggagaagaaaaggtgtaaggctttctctgggcactctgtgtcataatataccagaagaaatctaacttttggttcatttagcatcacatcacatgaggtgcagaagttatttatttataagcttaaggatttgtcttgagagcagtgagtcaaaagactaaatttcgaggcgggcagatcacttgaggtcaggagttcaagaccagcctggccaacatggtgaaaccccatctctactaaaaatacaaaaattacccgggcatggtggtgggcacctgtaatcccagccacttgggaggctgaggcaggaaaattgtttgaacctgggaggtggaggttgcggtgagcggagatcgtgccactgtactccagcctggcaacagagcgagactccctctcaaaaaaaaaaaaaaaaaaaaaaaaa

SEQ ID NO: 389069 - DNA, 536 bp, Homo sapiens
aatgaatacccatggccatgttccaatataactttatttacaaaatctaatttagttcataggttacggtttgctgattcctaagatagagcattacagtgtctgtttcagatgggaagtaagtcttcctatggcatgttcaggccctccttttcagggaatgagaaagagtggggagggtatttcaacaagtaataaattgcagaataccctccccacaaaaatacacatatgtcagactctttattatggtaaaagcacaaaacaggtcatctttttgtggaaatgctggagtctaccttttcctttttatcttctgatttttgttcctaaaataaaatcccaagtgatgttgcctcattccaagtcagttttgtagaccatgtaacatgtcttaatacactgtatggggaaaaaataaaagttagccttagatttctttgttttctatggttattgttgtacagaagaaagacaaactgtaaataatgtatatttaataaagagaacattttgtatgattttgtgtggaagac

SEQ ID NO: 389070 - DNA, 713 bp, Homo sapiens
tggctctgtcttattacccatgggacaggatcataacttggtctgggtcatttgtcacctttgtcctgggcttcaaatctagaagtttagattttttggtattctcagtttctgtccacatggttctttgagttttttcctaggcagctgctagaaagattttgatcaactggtcaaagatattaaagaagtcaatgttgatcagtaggaaaatttagagtgccagataaaagaggtgtctgggatggcagtgtcttgtcaaagggctggaggtgatgcgttcacttgctttggaatcacagattcgggaatgtgacggcaatgtgacgcagacctcgctgctgaggcgaaaaggacgttagaattaagggactcagaagacatcaaagttaaagcggttcttgttgcccggagaaaacagaaatacgaaagcatctgcctggggagtatcaaggtactcctttcatttctccagcagaggagcagcagggacagtgatcgactctgaggaagtgagaggcccggagagcttccagcccggccatcctaacaccaccttagaattggggcgcctgagacagccctcagcaccaggctcccagcccaggatgctctttgagctctgtacttaccttccagtagcttttcctagaatccccttcctgattaagtgaaatgaggggtaatagatgggcaatttacacgagttagaa

SEQ ID NO: 389071 - DNA, 361 bp, Homo sapiens
gctcagctgcctcaagaagctctagttagacaaaacaaacatggtggaaacaattgcatgtaactgagggctaaataacatggaaaagatgcaacatgtatccatagacttgtggacagtgtattcacaggaggcaataaaggcagtgagaatacctaggaaatgtttcctggaaatgctatccttgatctcagcttgaaggatggtcagaggacaggatacatacagccccaagaagaggagaggggattccatctactcttatctctttcactcccctgctcacagttgatacttagccagcatcacctggaaacatgagagttgaaaagcaaatctccagacccatcccagtcctatg

SEQ ID NO: 389072 - DNA, 335 bp, Homo sapiens
ctggctctgtggctcaggctggaatgcagtgggccgaggttggctcactgcaacctccacctcctgatctcaagccgtcctcccacctcagcctctcaagtagctggaactacagtggaactacaggtggacaacatcacacccagctaatttttgttattttttgtagagacggggtttcaccctgttgcccaggctggtctcaaactcctgagctcaagcaatctgcccacctaagcctctcaaagtgctggcattacaggcatgagccaccgtgcctggcctgggaagctcttttaacagaggtgatgtaaagtagaaaaagcagtgggctc

SEQ ID NO: 389073 - DNA, 426 bp, Homo sapiens
agcaaaaccacccaaaatactaccataataatactacggagaggaggggaattaatgaaaaaggatacataaatctatatcccttctgaatctgtttacttatgtgctctttaaatactattgtagatgctaaacaaatggttttcttgaatacagtgcatttgcccctatgccaattagatctgaactttgacacaatgtgttttacatacaggagaagaaaagagaacattatatgtgactgccatatgacaaggcaactttgggtattctgggagaaaaaagctgttttggcagtaagagaaagtgctggcaatgtgcaccaacgtaactcgtctgtcactttaagagctgaaataggaaaacctgtaccatttttgtacttttgttcattcttttcaactcattctaagttgccccctggga

SEQ ID NO: 389074 - DNA, 1041 bp, Homo sapiens
gcgggaccctcaagggcaggccacagtgggatgactcatcctcatgggcaatgccaggggaccaatatcagggtgggcagaggtttgggcagggctgatgtgaacacaaatgtcagtgactgagccaggccccaagaaccctacaggagaatgttcagagagccccctcttcatcccagtcgataaaacccaccaaagccaggaggctccggttgatggtgggaatggagttctgggcaggtctgcttggccgccctcacctctccccgggaatcccaagtcacctctgggaaccaagatggaaatgagagaaagccccctggtttctacaggaagccccccaacaacacacaagtcgttatggaagagcacaccatgctcagatgggcccccacagcagagtcttccagaacacgctgtcctggagaccagggtccgaggaccaggctgcccctcgccagctgccacttcagcctcggtttcctcacctgtgatgggaaggacagcctcggcggagcctgtgactggcatctgggtgggctttgcacaacatgaagaattactcaaatgtacagccaaggccaccccacaaccccctgtccacagagagccccacttgttcctggcagtgattggcctcaccagggtatcactttgattagatactaagtttccatctgttacagacaggttcattctgagtatcacagcactgccagggacaaaagccacctgcacgcagtgatgcaggcgctctgcacctgtcatgcaggtgttcacgagaagccgtccaggaacccccgaagaacgggctttccccaagtctgagcaacactcgcttgctggggccaagcagaggctggaccccaccccacccaccctccagtgtagctcatactgggaagaatttgcagggtcagataacagtaatctgacagatgccacctcacttaatgccccgagtcagatgacttggtttgcccagtttgacagagagggaggctggataccagagctgttgcatagttgatctgaggtccc

SEQ ID NO: 389075 - DNA, 633 bp, Homo sapiens
ggcaatgtaagaagtgcttttcaccgtccgtgccatgattctgaggcctccccagccatgtggaactctaatgctatgaccatctgcccaagctggaatcatgaactccatcctccttatccactgggaggtcagttctgccctagaactgttaccgaatagagttgcccaggttctcggcctgttgaacaaataattgaacaaaatgcacaaagtaacaaaagaatgaagcaaccaaagccaacgcaacagaataagggagtaatgaaagcacagatgtattgaagacaactcactgagtgggactgggctccagcaagctgcacaagagcctctccagttaggatttttataaagccaaaagaacttggcaacacccctaggtgccctttagaggcctccaattggttacatcctatgaaggattggcctgcaaccaatcagaggctgaagtagaaatatctgtcttgtcacaggattgaagatatggcctgtacgcagcccagtcttgcctagaactggctgcacctgctgttcctttgcttatgccccaacccttggctaccctaattccctattctcctgcctcagaactatcttctgatctgtccatgtcttttactcctttgtcat

SEQ ID NO: 389076 - DNA, 1170 bp, Homo sapiens
aatctagacccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattaaataaaaattagccattccagaaata

SEQ ID NO: 389077 - DNA, 1613 bp, Homo sapiens
aatctagacccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttaaaaaatgga

SEQ ID NO: 389078 - DNA, 665 bp, Homo sapiens
agctcgtgccccccaaatggcaatccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttaaaaaatgga

SEQ ID NO: 389079 - DNA, 367 bp, Homo sapiens
ggctgccaatgatctgtactataacaggtatattagaaaataccaaattctcttagagaaaaaaaaattgcacaacaatctcaacactgagaggactgtccaaggatgaaagcaaggtactcctaggttagtagtttttcaaacctatagatggcatttggaaagaagtacacgcataggcttcaaaaaaccctgaacaccagaaacctaattagcactttcattttaggggcacgggctttcccttatccttttctacagccaaccttaatggggtccaattaaggcaacaatgaaaggttacaaaagtctacaaaaaggtcccattacagcatttaaacagggttcattttttttaatcaaatag

SEQ ID NO: 389080 - DNA, 243 bp, Homo sapiens
ctagaggatctgagaggcaccagggaggctttgcaaatccaaacatttaagggaagtggtttagggatggaagagaaacacggtagaggtctggggctgtggattttcatctagggtgggtggggaaggaagggagtaaactttagcccaataaagaggaacttttgcatcctccagagcagcctagagaagtgctgacctccctggcccctcaaaggaagagggctggagagatgccgagag

SEQ ID NO: 389081 - DNA, 813 bp, Homo sapiens
ctcccagtacagtggcccagggcagactagctggaatcagcctcccgggtgggtttcgaggcgtttccagggtcaggggtcaagtaggggcatgttcccgggacactgcttctttctgccagaaggacgaagaatctggagagtgcaatatttggatctggtcctgctgatgtgtttctgtgctacagaaaccttctccacccctcttctacccaacagctagaggacatggggtccggaagtgcatgtggctggagccagtgtggtcgctgtcgtgatggccgagtccagatgagctgccgctggggaaacacagggtacctgaggtctgaggtcgggacgtctttgtccaaccactaagagtccacattctcctttggagccgggtctccgttttctccagcatcatgggcccctcaaggaagctgatgcatgccacaggctgtcttctcagaaaaggtacccaagaacacattttgggtttgcatgtggattgggaagcccaacgtggcctccagcggtgctccttggctttgtctagactgcaggatcccacccatgccctgtggatttgccacgtggacactgacgtgagcaaatggacaattcaacatcagtggcagaaaggagctcagtctggttcacacgtggaaggcagcacattctgaaagagaatcacttgaacccaggaggcgaaggttgcattgagccaagattgtgctattgcactccagcctggacaacagagcaagactctgtctctcaaaaaaagaaaaagaaaagcgacgacattcagtcaatcagccagatatt

SEQ ID NO: 389082 - DNA, 327 bp, Homo sapiens
ccagctttgttcctttcaagcacctcgagtcataaaataactctcaaagattgaagaatctttttgagagtaaattaagatttcattggacatatgcacttgttggttcaagaatgttttttcttgttctccaattttcttgtcatttggaacctgatattaatcagaatttctatgtgtgtccctttgccctgtattttcttcaagatctcttcattataaacataaacttttaagttcctgattttctctgttctcccctttagaccagtactgttcaatagaaatataatatgaaccacatatatcacttaaaaataaacaagt

SEQ ID NO: 389083 - DNA, 317 bp, Homo sapiens
gggtttctccatattggtcaggctggtttcaaactctcaacctcaggtgatctgtctgccttggcctcccaaagtgctgggattacaggtgtgaggtattattttttaagtaggagtatttggacctaaacaggcagaattcttcaacaaagtacaatgaaaggcatttctttgacagtagcctgaatttggaggctcatttgcaaaggcactttccactgccactctaccccagaaattgcttatgaaataattctggcatttactccttcttcctcccctcccccttttattaaagagactagcttgtacaaagt

SEQ ID NO: 389084 - DNA, 749 bp, Homo sapiens
tcttcagtgatcatgattcactaactttctgtgctagatatagttcatgcttagcatagccatgcaggataacttccaggtccttaatctgttacccttaggagttgtctcgttgttagtttacaggttctcccctttttagtatgttactagccttgtattgtacatgtgacaaatgttcttccaaagaacattgaatacaaacattggtcattttagccaagttagaattttagttccaagctacctaaaatttaataacacagtccacgtcaaataatgtaaactagtatatgatataatttcaaaaggtatcaaaagttattctctattcgtgggaacattggttgtggtactgctcattagctttatatacactggtgttttattcagaaacaattttctgaatttttctggacctcaagtaatagaattttcatattgttttttcttgatttttttcttccaaaattataacacagactgtagctgatgccataataaagaaatgtaccttcatgctactcatttaaatatccttgcgtgtgactaattaacttaattcattagtacactctattaataaggcaagcaaaaatcctttgttctgtgtttgtgttagcttactaattttgttcttcaacatggcaaaatttttatccctgtccatggtcagaactgcctgataccgaaatcgatctttcaatcacaggttgggactagtgtgctagtatatatgcctctctgcc

SEQ ID NO: 389085 - DNA, 467 bp, Homo sapiens
agccagaaatgtaatcccatcctaccgtgtttgcttggttaagttgctaaacacgtctcattttataagggaagaaaagagaagaaaaaggcttctaaatgcccatgaattgttagaagccatgtctggtgcttaatttcatttaattctcatggctgctggcccagaaggtgttaatttttagagtcaaatcttagatttgcaaggggatttggctgaggtcacacagttaagtggcatgatttaaatctgttttccaagtcccttttctttgccctgcatttaggaggagggccttcagcacccccaagctgaactggattccacttgaatcttgtcctttttataccaaacccatctgggggatggagtgttgcatccgcagcacatcccaagtgacaagtgcagctgatgccatcactccctgtggtagacgagccaatcgttaagtggctatttatgtgtcg

SEQ ID NO: 389086 - DNA, 393 bp, Homo sapiens
gccacacgcatttgctgagagtggatcacagggacagcacagccacctttttccagccagggaggagcatggcccagaaggaaaggaaagatggggatgcgagacaaaagaccaacccctcccccaaggacccattcacccagggcagaaaggtctctgcttctcaactgctgaatcccagggggaaagttccaaagtgtggtaacagaaccttccctgttccagtttcctaagccccactcacccgtcgcccatggagggaaggcacggaaggcagcctcagccgctggcgctgggattcattcgctcttgctctttcccaggggggatgaactctgatcctctcctgtccctctgtccactccagctttaaggagggagaggggccccagg

SEQ ID NO: 389087 - DNA, 233 bp, Homo sapiens
ggggcgcagagggtagagtggctgctcttccagtcttaggtctgtatggaagcacttatgttctaaggcagtgagggctggctttgctggtccaagaagaggaggatgcctgaggtgcttggacaactccagatgcttgtagggagagagggaccagaggcaggagagactggtcctgagaaggaagatctcagcatcccagctcctggatctttcacctcttgttcagaccc

SEQ ID NO: 389088 - DNA, 467 bp, Homo sapiens
ttctcccctgctctgagaagctcttccaagaatggcagctggaaggatgctctaagcacagggaaaaacaggacctgtggaattaataagtaaatatgcaaaataatgttattagcagggattacagacaggaatacagaatctttgctataaacctgcttctatgtgggaactggaacaccactaaagtgacacatgcatctcaatgaaggtgtgacaagtgaaagagacagttctggaaatttcctttgacaagaatataaacatacctctcagctaagactcttcaaccatgcggtcagcccctttctgcgtggcaccaactcctgcacactagcagcctagattcttagggaggatttccttctacgtgggtgggttcagacagatcttccacctactccacatactagatgcccgcacacagagggaatcacagtgaggggtttcagactctcctaagtctt

SEQ ID NO: 389089 - DNA, 730 bp, Homo sapiens
gggacctcttggtaaggaagtgagagtagtctctaggagcttagagctggtcccagctgatagccagcagggaaacagggattttgatgccacaactgcaaagacctaaattatcccagtgacaacaacgaattaggaaaagaacactcaactccatgtgaaaacgcagctggctgacaccctgatgttaacctgagcagaatccagccttgaattgcctggacttctgacccacagaactgagctaaatggatgttgttacatgttgctcaatttgtagtcatccattacctagcagtagaaaatgaatacacctccaaatgtggccaaacaaatccctttcagtgcactgggaaagcatggggttgaccagaacatagaggagtttttgggcacagattgtcccaatagaagtcataccgtaccctgaacaactcctgtgggttcacaaagtattcagatttacggagtactgaggttttatcattcagctttagtatgttaaaagcatgtatagtgtccaaactcatcaagcacatttgatctgggcaaaactccaagaattctatgagtttgaagctcagttcctctcagcatttgggtccataatcatgtttgtaagcagatggtaatccaagacattgtatgatagaaaaaccctacctcaatattttctctctaaatccaaatcacttccctaagatgtgtaatagtcaaataaaatggtaaa

SEQ ID NO: 389090 - DNA, 820 bp, Homo sapiens
tctttagcataatagaaccagaaatggaaagtgtctcttattgtgctagatacttgggtagagttataaggattctcagaagctgagcagaaatagctctagacaagaactgaatagggtgggcctacttacatgctgcagttggaaccctgtgaaatggtatatattgttcaagatttccgaacttcagtgtctttgtcaataaaatattacaggtgctttacttacctcaactattgttcttaatacaaaatgtagaagcacattgaaaacgttataaaaacagagatgaagaatgatgttattggttatggtaatatgaaggttacctcagattcttaccactttcaacctgctcacaatgtaaattctgttatcaatatctaatagaaaagggcctattattatatattcgtgttaaattgttcacatatagtacacgtaactttgtgtgcaaatcttccctctagggcattccctagaaagtcctcaatttagctagcagtgtattgttgattattaagagaaatccgccaccagaaagtccattaatagaggatatgttccttctgaattgtaattttcaacttaattgtaatagatttgctgcttttagtttttattaacttcatagtaatgtgttaaacaatattcattttttaaagtaacattacatatataacttacataaattagattcttctaatgtgaagatcagacagtgaaggtctgacttttaaaagaaatctaaaattaatttcaaactctaaaaagatttgcttatattatatgtaaataaatacgtatgatacattaatac

SEQ ID NO: 389091 - DNA, 376 bp, Homo sapiens
tctggaaatcagacaatttgggggcaccaggttatactgaaagagataaagaagttttatgtccttattttgccataaatttgaggaatgctgagagattggccagtatctcaaaactcatacacaatctgaattattttttaattttgttttctttttatgtgaaataattatgtagcttttcttgaatatatctattttggggaaatgaagagaattatggaagaactaaaatgtaacccttctcttcagcctccttttgccattgacactgcttttcagtagatttgtgaaggaggctacctcagttgaaagtagtactcagttttgatctttttctagatggatttgggtcttactcttataggtcacaaga

SEQ ID NO: 389092 - DNA, 363 bp, Homo sapiens
aaaagtctccacttacatgagggaaattagggaataaccacaaatctccagaggaagatgaaggctcagaaaagacccaagatgaccttaagtttatatgtcaagataatccttagcaaagacacaagctacaccaactttttaaagtagcaaagcctggggaagggagtgaatctgattttcagagttaacacattattagattcaaatatgcaattttgacaaaaaaatcacaaagtatacaaagaagcaggataatatggtccactcaaagattaaaaaaaagtgagccaacagaaattgtccctgaaaaagacctgatggcagagctacaagaaaaacttcaaaacatttgtactagag

SEQ ID NO: 389093 - DNA, 479 bp, Homo sapiens
ccccatttggcgaggcagtctctcagtatttgtaaatgaaaactattttgcatttttttagaaagatgttttctcaatttttttgtttattaacagatctaagtatacttaacctttctgtgccatatgaatgaattatatataactgacaattcagaagccagtcctatttaattttactaacaatttaaaaactagttttatttatcaaatattaacacatagacacacagaagcagatcttacagctttcataaataattttcatttgctggcttttaaataattttttttccccattctactaccaatcttccaattatctgtttcattgccctaagcaattgttagctgggcaaccctaaatttgcattttcaaagggatggctcttagaagaaacgaggtagaaaatttatatctccaaagcacagagctgagatttcaggcctaaataattaattgtataatcatttgccca

SEQ ID NO: 389094 - DNA, 750 bp, Homo sapiens
atgttaccacttaaattatcattcaaatataaaagcatagtaaagctgacattaagcctcaagcatacaagttcacagaaaatttgtcacacaaggacccacattataagagaagcagaaattcatactgctttaagagatatcagaggctgggtgtggtggcccatgcctataatgccagcactttgggaagccaaggcaggaggatcgtttgagcccaggagttcaagaccagcctgggcaacatagtgagcccttgtctctataaaaaataaaaaaattagccatggccctggtgtggtggctcacgcctgtaatcctaccgccttggcctcccaaagtgctgggcttacaggcatgagccactgcacccagcaggaaaaatttaatataaaggttactaactaataaaacatggttaactattaagacagataaaggataactctaaagaataccagaacctgggcacaagggctcatgcctgtaattccagcactttgggaggccaaggtaggaggatcacttgagcccaggtgttcaagaacagcttaggcaacatagtgagaccccatctctacaaaaaattaaaaaacagccaggcatagtggtacatacctgtagtctcagctcctcaggaggctgaggttagaggatagtttgaacctaggaggttgaggctgcagtgaatcatgattgtatcactgcactccagcttgggtaacagagtgagaccgtttctaaaaatta

SEQ ID NO: 389095 - DNA, 426 bp, Homo sapiens
atgttaccacttaaattatcattcaaatataaaagcatagtaaagctgacattaagcctcaagcatacaagttcacagaaaatttgtcacacaaggacccacattataagagaagcagaaattcatactgctttaagagatatcagaggctgggtgtggtggcccatgcctataatgccagcactttgggaagccaaggcaggaggatcgtttgagcccaggagttcaagaccagcctgggcaacatagtgagcccttgtctctataaaaaataaaaaaattagccatggccctggtgtggtggctcacgcctgtaatcctatcaaacatggtaccatccctaatgaagtcaacgggtccagcatgacaggatggaagtacaagtgtcagcacctatgtgagtcccaagaggggaaattagaaaca

SEQ ID NO: 389096 - DNA, 220 bp, Homo sapiens
tggatcactcataagttttcagtggttaattactacagtttaagaagacgtgtgatttatttttagatctgacccagcagatcatacctctcccttgaattacatggtcttcttttggcttctaagatgtcacactcctgtcttagtggccactgctcctcaagccccctttgctagctcttcctcatctgtccagccctaacctgaccgtgctatgtaa

SEQ ID NO: 389097 - DNA, 447 bp, Homo sapiens
ctgaagatctagtttggaacacccaaagttcaagtcttcaggcaacgccgtcatctattctgtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaaggtaagtgtcacaacaaaggaagggattcctggactattgtaggagcatttacacagctaaggcctaaaggaagcaaaagcaagtggcaaatgcctgtattactcttttgttgaattgggctatctgagtaagctgccctagggtgtggcctagtcttttattcctagctctggcctctataatatacattattaatattttcatgttattctgtccac

SEQ ID NO: 389098 - DNA, 4017 bp, Homo sapiens
  misc_feature (1603)..(1603): n is a, c, g, or t
  misc_feature (1872)..(1872): n is a, c, g, or t
ctgaagatctagtttggaacacccaaagttcaagtcttcaggcaacgccgtcatctattctgtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaagaaactgacttatgcaaaggaaactgtaagcagctctgaactgtcttctccagttcctgttggtgatacttcaacattgggagacactactctcagtgttccacatccagaggtggacgcctatgaaggtgcctcagagagcagcttggaaaggccagaggagagtattagcaatgaaattgagaatgtgatagaagaagccacaaaaccagcaggtgaacagattgcagaattcagtatccaccttttggggaagcagtacagggaagaactacaggattcctccagctttcaccaccagcaccttgaagaagaatttatttcagaggttgaaaatgcatttactgggttaccaggctacaaggaaattcgtgtacttgaatttaggtcccccaaggaaaatgacagtggcgtagatgtttactatgcagttaccttcaatggtgaggccatcagcaataccacctgggacctcattagccttcactccaacaaggtggaaaaccatggccttgtggaactggatgataaacccactgttgtttatacaatcagtaacttcagagattatattgctgagacattgcagcagaattttttgctggggaactcttccttgaatccagatcctgattccctgcagcttatcaatgtgagaggagttttgcgtcaccaaactgaagatctagtttggaacacccaaagttcaagtcttcaggcaacgccgtcatctattctggataatacctttcaagctgcatggccctcagcagatgaatccatcaccagcagtattccaccacttgatttcagctctggtcctccctcagccactggcagggaactctggtcagaaagtcctttgggtgatttagtgtctacacacaaattagcctttccctcgaagatgggcctcagctcttccccagaggttttagaggttagcagcttgactcttcattctgtcaccccggcagtgcttcagactggcttgcctgtggcttctgaggaaaggacttctggatctcacttggtagaagatggattagccaatgttgaagagtcagaagattttctttctattgattcattgccttcaagttcattcactcaacctgtgccaaaagaaacaataccatccatggaagactctgatgtgtccttaacatcttcaccatatctgacctcttctataccttttggcttggactccttgacctccaaagtcaaagaccaattaaaagtgagccctttcctgccagatgcatccatggaaaaagagttaatatttgacggtggtttaggttcagggtctgggcaaaaggtagatctgattacttggccatggagtgagacttcatcagagaagagcgcngaaccactgtccaagccgtggcttgaagatgatgattcacttttgccagctgagattgaagacaagaaactagttttagttgacaaaatggattccacagaccaaattagtaagcactcaaaatatgaacatgatgacagatccacacactttccagaggaagagcctcttagtgggcctgctgtgcccatcttcgcagatactgcagctgaatctgcgtctctaaccctccccaagcacatatcagaagtacctggtgttgatgattnctcagttaccaaagcacctcttatactgacatctgtagcaatctctgcctctactgataaatcagatcaggcagatgccatcctaagggaggatatggaacaaattactgagtcatccaactatgaatggtttgacagtgaggtttcaatggtaaagccagatatgcaaactttgtggactatattgccagaatcagagagagtttggacaagaacttcttccctagagaaattgtccagagacatattggcaagtacaccacagagtgctgacaggctctggttatctgtgacacagtctaccaaattgcctccaaccacaatctccaccctgctagaggatgaagtaattatgggtgtacaggatatttcgttagaactggaccggataggcacagattactatcagcctgagcaagtccaagagcaaaatggcaaggttggtagttatgtggaaatgtcaacaagtgttcactccacagagatggttagtgtggcttggcccacagaaggaggagatgacttgagttatacccagacttcaggagctttggtggttttcttcagcctccgagtgactaacatgatgttttcagaagatctgtttaataaaaactccttggagtataaagccctggagcaaagattcttagaattgctggttccctatctccagtcaaatctcacggggttccagaacttagaaatcctcaacttcagaaatggcagcattgtggtgaacagtcgaatgaagtttgccaattctgtccctcctaacgtcaacaatgcggtgtacatgattctggaagacttttgtaccactgcctacaataccatgaacttggctattgataaatactctcttgatgtggaatcaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtagtggctccagcaggcagcctgacagcctctcatctattgagaatgctgtgaagtacaaccccgtgtatgaaagtcacagggctggatgtgagaagtatgagggaccctatcctcagcatcccttctacagctctgctagcggagacgtgattggtgggctgagcagagaagaaatcagacagatgtatgagagcagtgagctttccagagaggaaattcaagagagaatgagagttttggaactgtatgccaatgatcctgagtttgcagcttttgtgagagagcaacaagtggaagaggtttaaccaaaactcctgttctgaaactgattagaagcctggagaagatggagattacttgttacttatgtcatataattaacctggattttaaacactgttggaagaagagttttctatgaaaaaattaaatatagggcacactgtttttttttcagcttaagttttcagaatgtagtaagagatgttaccatttttatttctataaagactgaatgctgtgtttaaataattgaaaactacgtaaactctggaaagtattctataagaaaaagctggacctaggatttagggctgcagttgctgtctgcttctgaatcactgggggtgtctcctaagaactgtgcctcgggtttttcaataggaaaataaggtgagactcttacatggagaagtctggcttagtaagggaatattttggagcatatttgttattgttgggtagaaggggaaacctttgaaatagtcttaatggatagtttataatcaggcattcatctaaataaaattctttcttttttttgatcaaactgctaaagaaaaagcaaacttttttgctgcaggatagaattcgggttgtatttttatgcttctatcagtgtcttgcatttcctgagcatattaatcaagaccatgttattgttatgttaactatgttaatatcctttttttcttagttttcaggatgaatgcatatatatatatatatatatatatatatatatatatatatatatatatatatataaagtttagaa

SEQ ID NO: 389099 - DNA, 3184 bp, Homo sapiens
  misc_feature (1603)..(1603): n is a, c, g, or t
  misc_feature (1872)..(1872): n is a, c, g, or t
ctgaagatctagtttggaacacccaaagttcaagtcttcaggcaacgccgtcatctattctgtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaagaaactgacttatgcaaaggaaactgtaagcagctctgaactgtcttctccagttcctgttggtgatacttcaacattgggagacactactctcagtgttccacatccagaggtggacgcctatgaaggtgcctcagagagcagcttggaaaggccagaggagagtattagcaatgaaattgagaatgtgatagaagaagccacaaaaccagcaggtgaacagattgcagaattcagtatccaccttttggggaagcagtacagggaagaactacaggattcctccagctttcaccaccagcaccttgaagaagaatttatttcagaggttgaaaatgcatttactgggttaccaggctacaaggaaattcgtgtacttgaatttaggtcccccaaggaaaatgacagtggcgtagatgtttactatgcagttaccttcaatggtgaggccatcagcaataccacctgggacctcattagccttcactccaacaaggtggaaaaccatggccttgtggaactggatgataaacccactgttgtttatacaatcagtaacttcagagattatattgctgagacattgcagcagaattttttgctggggaactcttccttgaatccagatcctgattccctgcagcttatcaatgtgagaggagttttgcgtcaccaaactgaagatctagtttggaacacccaaagttcaagtcttcaggcaacgccgtcatctattctggataatacctttcaagctgcatggccctcagcagatgaatccatcaccagcagtattccaccacttgatttcagctctggtcctccctcagccactggcagggaactctggtcagaaagtcctttgggtgatttagtgtctacacacaaattagcctttccctcgaagatgggcctcagctcttccccagaggttttagaggttagcagcttgactcttcattctgtcaccccggcagtgcttcagactggcttgcctgtggcttctgaggaaaggacttctggatctcacttggtagaagatggattagccaatgttgaagagtcagaagattttctttctattgattcattgccttcaagttcattcactcaacctgtgccaaaagaaacaataccatccatggaagactctgatgtgtccttaacatcttcaccatatctgacctcttctataccttttggcttggactccttgacctccaaagtcaaagaccaattaaaagtgagccctttcctgccagatgcatccatggaaaaagagttaatatttgacggtggtttaggttcagggtctgggcaaaaggtagatctgattacttggccatggagtgagacttcatcagagaagagcgcngaaccactgtccaagccgtggcttgaagatgatgattcacttttgccagctgagattgaagacaagaaactagttttagttgacaaaatggattccacagaccaaattagtaagcactcaaaatatgaacatgatgacagatccacacactttccagaggaagagcctcttagtgggcctgctgtgcccatcttcgcagatactgcagctgaatctgcgtctctaaccctccccaagcacatatcagaagtacctggtgttgatgattnctcagttaccaaagcacctcttatactgacatctgtagcaatctctgcctctactgataaatcagatcaggcagatgccatcctaagggaggatatggaacaaattactgagtcatccaactatgaatggtttgacagtgaggtttcaatggtaaagccagatatgcaaactttgtggactatattgccagaatcagagagagtttggacaagaacttcttccctagagaaattgtccagagacatattggcaagtacaccacagagtgctgacaggctctggttatctgtgacacagtctaccaaattgcctccaaccacaatctccaccctgctagaggatgaagtaattatgggtgtacaggatatttcgttagaactggaccggataggcacagattactatcagcctgagcaagtccaagagcaaaatggcaaggttggtagttatgtggaaatgtcaacaagtgttcactccacagagatggttagtgtggcttggcccacagaaggaggagatgacttgagttatacccagacttcaggagctttggtggttttcttcagcctccgagtgactaacatgatgttttcagaagatctgtttaataaaaactccttggagtataaagccctggagcaaagattcttagaattgctggttccctatctccagtcaaatctcacggggttccagaacttagaaatcctcaacttcagaaatggcagcattgtggtgaacagtcgaatgaagtttgccaattctgtccctcctaacgtcaacaatgcggtgtacatgattctggaagacttttgtaccactgcctacaataccatgaacttggctattgataaatactctcttgatgtggaatcaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtaggtatgttgtagttacagattttgactttagaggctatagatatttcctctaaagaaaaggggcctgcacctataattttaggatacttattatagtatgcattatagaagttatatctaggcaatagatgggagccatctaactgtcatgtgaggatgagttgttaaacaggcctgaatttcaattcagtaatttatgctgttagggaactgcaaaaaaaaaa

SEQ ID NO: 389100 - DNA, 4669 bp, Homo sapiens
  misc_feature (2066)..(2066): n is a, c, g, or t
  misc_feature (2335)..(2335): n is a, c, g, or t
cgggctactttgaaaggacaaccatttttctttccgctaatttataatggttttgaagtggttgttcattctcaaacatagacttttaaatgttaggtctttcctataactctttgttattggaagtttcaaggatttggacactcaattaaggattctgtcctctcctcattcctttggttttggcccaaatgattatgtttcctctttttgggaagatttctctgggtattttgatatttgtcctgatagaaggagactttccatcattaacagcacaaacctacttatctatagaggagatccaagaacccaagagtgcagtttcttttctcctgcctgaagaatcaacagacctttctctagctaccaaaaagaaacagcctctggaccgcagagaaactgaaagacagtggttaatcagaaggcggagatctattctgtttcctaatggagtgaaaatctgcccagatgaaagtgttgcagaggctgtggcaaatcatgtgaagtattttaaagtccgagtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaagaaactgacttatgcaaaggaaactgtaagcagctctgaactgtcttctccagttcctgttggtgatacttcaacattgggagacactactctcagtgttccacatccagaggtggacgcctatgaaggtgcctcagagagcagcttggaaaggccagaggagagtattagcaatgaaattgagaatgtgatagaagaagccacaaaaccagcaggtgaacagattgcagaattcagtatccaccttttggggaagcagtacagggaagaactacaggattcctccagctttcaccaccagcaccttgaagaagaatttatttcagaggttgaaaatgcatttactgggttaccaggctacaaggaaattcgtgtacttgaatttaggtcccccaaggaaaatgacagtggcgtagatgtttactatgcagttaccttcaatggtgaggccatcagcaataccacctgggacctcattagccttcactccaacaaggtggaaaaccatggccttgtggaactggatgataaacccactgttgtttatacaatcagtaacttcagagattatattgctgagacattgcagcagaattttttgctggggaactcttccttgaatccagatcctgattccctgcagcttatcaatgtgagaggagttttgcgtcaccaaactgaagatctagtttggaacacccaaagttcaagtcttcaggcaacgccgtcatctattctggataatacctttcaagctgcatggccctcagcagatgaatccatcaccagcagtattccaccacttgatttcagctctggtcctccctcagccactggcagggaactctggtcagaaagtcctttgggtgatttagtgtctacacacaaattagcctttccctcgaagatgggcctcagctcttccccagaggttttagaggttagcagcttgactcttcattctgtcaccccggcagtgcttcagactggcttgcctgtggcttctgaggaaaggacttctggatctcacttggtagaagatggattagccaatgttgaagagtcagaagattttctttctattgattcattgccttcaagttcattcactcaacctgtgccaaaagaaacaataccatccatggaagactctgatgtgtccttaacatcttcaccatatctgacctcttctataccttttggcttggactccttgacctccaaagtcaaagaccaattaaaagtgagccctttcctgccagatgcatccatggaaaaagagttaatatttgacggtggtttaggttcagggtctgggcaaaaggtagatctgattacttggccatggagtgagacttcatcagagaagagcgcngaaccactgtccaagccgtggcttgaagatgatgattcacttttgccagctgagattgaagacaagaaactagttttagttgacaaaatggattccacagaccaaattagtaagcactcaaaatatgaacatgatgacagatccacacactttccagaggaagagcctcttagtgggcctgctgtgcccatcttcgcagatactgcagctgaatctgcgtctctaaccctccccaagcacatatcagaagtacctggtgttgatgattnctcagttaccaaagcacctcttatactgacatctgtagcaatctctgcctctactgataaatcagatcaggcagatgccatcctaagggaggatatggaacaaattactgagtcatccaactatgaatggtttgacagtgaggtttcaatggtaaagccagatatgcaaactttgtggactatattgccagaatcagagagagtttggacaagaacttcttccctagagaaattgtccagagacatattggcaagtacaccacagagtgctgacaggctctggttatctgtgacacagtctaccaaattgcctccaaccacaatctccaccctgctagaggatgaagtaattatgggtgtacaggatatttcgttagaactggaccggataggcacagattactatcagcctgagcaagtccaagagcaaaatggcaaggttggtagttatgtggaaatgtcaacaagtgttcactccacagagatggttagtgtggcttggcccacagaaggaggagatgacttgagttatacccagacttcaggagctttggtggttttcttcagcctccgagtgactaacatgatgttttcagaagatctgtttaataaaaactccttggagtataaagccctggagcaaagattcttagaattgctggttccctatctccagtcaaatctcacggggttccagaacttagaaatcctcaacttcagaaatggcagcattgtggtgaacagtcgaatgaagtttgccaattctgtccctcctaacgtcaacaatgcggtgtacatgattctggaagacttttgtaccactgcctacaataccatgaacttggctattgataaatactctcttgatgtggaatcaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtaggtgccgggtgggtgagaactggtggtaccgaggcaagcactgtgaggaatttgtgtctgagcccgtgatcataggcatcactattgcctccgtggttggacttcttgtcatcttttctgctatcatctacttcttcatcaggactcttcaagcacaccatgacaggagtgaaagagagagtcccttcagtggctccagcaggcagcctgacagcctctcatctattgagaatgctgtgaagtacaaccccgtgtatgaaagtcacagggctggatgtgagaagtatgagggaccctatcctcagcatcccttctacagctctgctagcggagacgtgattggtgggctgagcagagaagaaatcagacagatgtatgagagcagtgagctttccagagaggaaattcaagagagaatgagagttttggaactgtatgccaatgatcctgagtttgcagcttttgtgagagagcaacaagtggaagaggtttaaccaaaactcctgttctgaaactgattagaagcctggagaagatggagattacttgttacttatgtcatataattaacctggattttaaacactgttggaagaagagttttctatgaaaaaattaaatatagggcacactgtttttttttcagcttaagttttcagaatgtagtaagagatgttaccatttttatttctataaagactgaatgctgtgtttaaataattgaaaactacgtaaactctggaaagtattctataagaaaaagctggacctaggatttagggctgcagttgctgtctgcttctgaatcactgggggtgtctcctaagaactgtgcctcgggtttttcaataggaaaataaggtgagactcttacatggagaagtctggcttagtaagggaatattttggagcatatttgttattgttgggtagaaggggaaacctttgaaatagtcttaatggatagtttataatcaggcattcatctaaataaaattctttcttttttttgatcaaactgctaaagaaaaagcaaacttttttgctgcaggatagaattcgggttgtatttttatgcttctatcagtgtcttgcatttcctgagcatattaatcaagaccatgttattgttatgttaactatgttaatatcctttttttcttagttttcaggatgaatgcatatatatatatatatatatatatatatatatatatatatatatatatatatataaagtttagaa

SEQ ID NO: 389101 - DNA, 441 bp, Homo sapiens
ccaattctctgaacacacacagtgggcaccatgtccaatagtcattagtcaagctctgtggtctggtatttacaaatttccaggaaacgagtccagcgtggtgcgagaggctctccgttactttgttcagtaagctgagatgttatcagaagtgacaatttttaaaaaaattattatttgttttaatattttaatctagaagccattggctacctggcattttgaaagttttccagtggttgaacatttacaagaacaattgtgaacctgtgcctgttggcttccaaatactgatcgttcctaaacattctcttaccagcataatgttgacctttgcacaacttccttctttctttggtgctcacatttctgtgatttaatcgtcctttttacaagtactttaagaaagaaaaaataaaaaagattttctagtagtaaaac

SEQ ID NO: 389102 - DNA, 142 bp, Homo sapiens
actccctcccataaaaatagggtaacctttaaaatcacaaacaacacagcccacactaccaacgttcttccgtcactgacagtgacaggatctagctagttctcatgctccaaaagttatatatatatacatgaactttaaa

SEQ ID NO: 389103 - DNA, 381 bp, Homo sapiens
tcctttggatgttattatttctcattattttaagcattgaaaggagaaaaaaaaagctactctggtgtcaataaataagagcaacactccttcatgggttttcctccttaagatttcttacttctacaatctcaccagacctcttggcaaatggtcccaccttgccccaacttatcctcatttcaggtaagacatttagcctctttggatctcagttttctcatatgaaaagtgaggaggttggattaggagcaagatgggtaactggtagcctaggggcagtattctggacagcagatatttgttagtctcacaaatgtatatgtatgtttaaagttgtttgccaatatgtaatagtcaagatagttctcataacatctc

SEQ ID NO: 389104 - DNA, 195 bp, Homo sapiens
agtaaagtgctgaacaaatgctaactgttattatggatctatcctgacccactgtctatcagtgtctatcaatctttatgcctagatgtgataacatgtgagaaaacaaacgggtggagaacttggccttccctaaagtgcagcatggaccagagttgggggtcagtctgaaaaagtgtgagaatttttaatgcc

SEQ ID NO: 389105 - DNA, 499 bp, Homo sapiens
aggttaagggccaaaagtgatttctacaagaatcctaaagagaagctatcatctctcctgtctcgtccttgcaaaggatagtggtcaggaatggggctggatctgccacattctggggaacagagatgacctcaaccttcagcaccagagcagttccagggagcaccaactggccaaagtcacaggtgaatcagtcaagagttttaagacagctttcccttgagataacacactcccgtgctggctgttctgacccagtcagaatgcaaatgtttgtgtagttatatttattaatagagtccacggttagccaggcctggcacatggctagggctctgtattgaaaccaataagtaaaagcctggaatttctattttcgttcccactcctgttgctactgggggccttttatccagtcctgtttttaatccagcagcctgcaaggggcaggaaagaggcaggtaaagttgtctagcaaggcagagtagaaggcacacct

SEQ ID NO: 389106 - DNA, 390 bp, Homo sapiens
ggaataggtgatctgttttctaacataatcaggaaataggccatcttgttcaatgaaatgttctggtcaatagcatcacattacacataccatacccatttaatccatattctgtgaatccaattatactaaactgcatttaactctaaaacccactgatcataatttaaatgctgatgaaaacatttgaagaccgtacagtgctttaatgatcacttacctttgcaccatgcagtactctagtattctcagtagcagctgcagtaatccctgtgatagaaaactgggtgaaccaggttttactaaaatcaatagaacattctgtagttattgcaagtactgtgagataaaggtcaattaattctaatagtcaagaagaaagaatatatg

SEQ ID NO: 389107 - DNA, 287 bp, Homo sapiens
atattgtatccattttgtaccttaggaaaggccatccatgagcatcactgggtggagatttttgggtaagaggtgtatagtttctagcacaagggtcaaactcaactccgatggaaaattcttcgttggggcagtgtcttctgaggcaatgtcatctcagccagtgaaatttgggggccagagtgatatcatgatgtcatctgggatgtgggactggggaatcctttgttgttgttgttgttgttttgagatggagtctcactctattgcccaggctggagctcagt

SEQ ID NO: 389108 - DNA, 327 bp, Homo sapiens
  misc_feature (18)..(18): n is a, c, g, or t
tctggtcgtcacaggacncatgggttacgcccctgatatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatac

SEQ ID NO: 389109 - DNA, 1107 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagtccgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggccccggagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagaggct

SEQ ID NO: 389110 - DNA, 987 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagtccgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggccccggagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagaggct

SEQ ID NO: 389111 - DNA, 1020 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagtccgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggccccggagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagaggct

SEQ ID NO: 389112 - DNA, 1074 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagtccgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggccccggagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagaggct

SEQ ID NO: 389113 - DNA, 983 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagtccgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggccccggagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagaggct

SEQ ID NO: 389114 - DNA, 427 bp, Homo sapiens
cctcttgtcagctggaaagattattaggagccatgaatgtcctttaatatggttatctttgttactattgagtttacagtttttcaccagaatctatgtgcctctttctcttctttaccctaattactgtcctaacattgacccagccaccagtactagggatgccctagctttatgctcacctattttatccataaaaaatcttcagaccagcctgggcaacatagcgggaccctgtatctaccaaaaaaaaaaaaaaaaaaaaaaaaaaagctgggtgtggtgccacacacctgtagttccagctacttgggaggccaaggtgggaggatcgcttgggcccaggagttcaaagctgcagtgatccctgattgcatgactgcactccatcctgagcaacagagagggaccctgtctcaaaaaaaaa

SEQ ID NO: 389115 - DNA, 391 bp, Homo sapiens
tggacaacagatgtctcatgagaatgacccatatatcctacatagtctaattagaagagttactactgtaacaatttcatgttcatgcaataccagctgcttcatgttcattcttataaaagaggaactaggactgaagcagtggctcatgcctgtaatcctagcactttgggaggctgaggcaggcagatcgattgagctcaggaatttgagactagctaggcaacatggtgaaaccccatctctactaaaaaaaaatacaaaaaaatggccaggcacagtggctcacacctgtaatcccaacactttgggaggccgaggcaggcggatcacctgacgtcaggagttcgaaatcagcctcgaccaacatggtagaacgctgtctctacta

SEQ ID NO: 389116 - DNA, 350 bp, Homo sapiens
ctcagaagaagagttccaaacaaaagatctactaccctgagaagcggtgaagtgctcctggggcccaccaaggccacacaagtcaaggagtggatggccttgccccagctatggctcagatcacctttgcaggatgacatcttgttgggagatggtcatcagagacagggccatggaagacgctgtcaggaggaggcacagaggaaaggctatgggagcacaaagcaagaaagtggccttctgcaagccaggaagagaggcctccccagaaaccaactctaccagcacatcgatcttggacttttggcctctagaacattgagaaaataaaagtctgctgttaaaccacc

SEQ ID NO: 389117 - DNA, 328 bp, Homo sapiens
ttttcatggcagcctgagcagactaagacagcagctaacacagcaagatcataccagttaaccttcctggttagaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgttagctgtgagggacaaggcagagaaataactgcccaagttcagcttcccataatgtttggggatgctatgactcaactttgatctatttt

SEQ ID NO: 389118 - DNA, 257 bp, Homo sapiens
gcaaatgacatactggcattaagtagtacagagagcttttgtggtcttactgctctaataaaggcagaaactgtcttaatttaacagccttctgttaaatgtagcttataaacttcccaattagttattattctatatactctgtaaaaacataaatttataatgtacagtatgtcatgtgtcacacaacctacataataaatgcacatttaagtaaagtatgttttgttccccaaatcatatactttatatatctc

SEQ ID NO: 389119 - DNA, 295 bp, Homo sapiens
tcatagtgagaattagtaaatattaagtagtattaggattattatcttgtggttaatatgaaaacagagggagactgggacagaataaataagttgggaagtgcagtaggagatgagtctagggtgagggacccattatgcaaagctgtataaaccagtgtaaggactttgtgtttagtttgatcgaaaagtgagctactggaggtttctgaattgagatgtaacgtggtctgacttaggttttgaaaggacctctggctgctttgttttggacaggctgtggaaagtcagaatg

SEQ ID NO: 389120 - DNA, 392 bp, Homo sapiens
aagctgtggacatgagtaaaattattcaggtaaaatacatttaggttgtatatttatgttaatggtcttcaaaaaagcttacttagcctaacatgaaaacagtgagtggctagccaggtgcagtggctcacgcctgtaatcccagcactttgagaggccaaggcaggtagatcacttgaggccaggagttcaggaccaggctggctaatatgggaaaccccctatctactaaaaatataaaaattagccaggtgtggtggtgcacacctgtattcccaactacttgggaggctgaggcacaagaatcgcttgaacccgggaagtggaggttgcaatgagccaagactgtgccattgcactccagcctgggtgacagagtgagaccctgtctc

SEQ ID NO: 389121 - DNA, 2086 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 389122 - DNA, 2106 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagcactctgctctgttccgaagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 389123 - DNA, 1203 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgccctgacatcctggacatgcctagcctgcacgtagcttttccgtcttcaccccaaataaagtcctaatgcatca

SEQ ID NO: 389124 - DNA, 2512 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcaggtacccttccgtgtgcctccacacctactacttcaagcccacaccacctcagaccctaaaccctcagctcctcagacctgtctaggggcctctccccagctggcctctcacgctctccgggaagcctccttaaccctgtccccccacagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctggtaacagcccctcttctggagcccttgcctgctccaagggtgctagggcccacccctgaagcctagaccaccatcccgccccagctgaggagaaacaggcaggagggtgtgcagtgacctcgactggtccctgggaggaggaccactccccacctctgaccctctcgtcctcacacagcttcaggaagggctgggcagccatcgaacccaagttccccacctcagcctgggccccaggtaacacataatggccccctaaaatcaagggagggcaggggcaggctcaggacagtgggtgtgcccgttcccaccccagcactctgctctgttccgaagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 389125 - DNA, 1548 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcaggtacccttccgtgtgcctccacacctactacttcaagcccacaccacctcagaccctaaaccctcagctcctcagacctgtctaggggcctctccccagctggcctctcacgctctccgggaagcctccttaaccctgtccccccacagcaggcccagaggaggcccggcggcagcctcggacatccgcgtgttcgccagcaactgctcgatgcacgggctgggcacgtcttcgggccaggcagcctgagcctgcgccgggggatgtgggcagcggcggtggtcctgtcagtggccaccttcctctaccaggtggctgagagggtgcgctactacagggagttccag

SEQ ID NO: 389126 - DNA, 379 bp, Homo sapiens
ccaaagtgcagggagtacaggtgtgagccaccgtgcccggcctctcccagggttcttgaaaggagtgggagaacccacagctgcttcttgccagcagtgggcaccaggcggtggccagcccacatttgaggccattcttgtcctcagggagaacgtgctggccctggacatcttctttgaggccctcaactatgagaccgtggagcagaagaaggcctatgagatgtcagagctgcttggtgtgtgtgcagggcccccagggctgggggggtgtgggcaggcaggtggctgtaagttgaagggtgaccctgtctccacaggtgacattgggggccagatggggctgttcatcggggccagcctgctcaccatcctcgag

SEQ ID NO: 389127 - DNA, 2027 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 389128 - DNA, 1343 bp, Homo sapiens
gatggccatcaccctgtctgcccgccccagatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcaggtacccttccgtgtgcctccacacctactacttcaagcccacaccacctcagaccctaaaccctcagctcctcagacctgtctaggggcctctccccagctggcctctcacgctctccgggaagcctccttaaccctgtccccccacagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 389129 - DNA, 2014 bp, Homo sapiens
cccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccaagatcacctcctccaatcctgccaggctagtgcctccctgccttccaaccttggctgtctcccacctctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcaggtacccttccgtgtgcctccacacctactacttcaagcccacaccacctcagaccctaaaccctcagctcctcagacctgtctaggggcctctccccagctggcctctcacgctctccgggaagcctccttaaccctgtccccccacagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagctctagacctgctgtctgtgtcctcggagccccgccctgacatcctggacatgcctagcctgcacgtagcttttccgtcttcaccccaaataaagtcctaatgcatca

SEQ ID NO: 389130 - DNA, 369 bp, Homo sapiens
cacagaccacaggagctgggagagtaagatgggactgggtccagggagtgctgatcaagtcatgtactggagtactcttctggggcacagaatgtaacaccatggcagagatctcacgagacaatgcccatatgtcagtaggctggctctggaaagcctagggaaaatgatggtccacactgtataaagtagaaacactagcctgtgttgtgactcacgcctgtaatcccagcactttgggaggcagaggtggatggatcacctgaggtcaggagttaaagaccagcctggccaacatggtgaaaccccgtctctactaaaagcacaaaaattagccaggcatagtggtgcatgcctgtaatcccagca

SEQ ID NO: 389131 - DNA, 235 bp, Homo sapiens
gacttgggttttgctttgctagtggagaatatggctgggatctgggttagggcagaaagctcaggtagatgacaggtgccagagcagtggttcaaacttgggagaatcacagcaggagcctattaacaatgcagattccagggccccttgatagacctgggaaggggggtgcaatcagcattgttaataagtttgtgtgattgtgaggcaggtggccccaggattgtgctctggt

SEQ ID NO: 389132 - DNA, 142 bp, Homo sapiens
ccaccttgacctctcaaagtgctgggattacaggcatgagtcaccacacctggtttctcacagtctcttattgcagataaaagaatcacatgaaatggttaaataactggatgggcaatatatatataatatatagcagagc

SEQ ID NO: 389133 - DNA, 320 bp, Homo sapiens
cccgaataggtcctgtggcgtctgtaacagtaatgtccaccagtcaggcaccttacactgctcttcccggcctcctcacgcggactctctgagactaattctgttattatccacacttcacagatgagaaaactcagccaggtttctgtgggcactgtactgggctggatagtgtccccagcaaaactcatgtctgctcagaacctgtgactgtaacctcatttggaaacggtccttacagacgtaaccaagtgaaaataatggcacctgctggaatagggtaggccctaagtccaacaagactggtgtccttctaaaag

SEQ ID NO: 389134 - DNA, 89 bp, Homo sapiens
tttaaaaaaagtaaatatatttcatttaaaaatttaatctcaattcaaattttttcagatatattctcagtaaaaatatactttggatc

SEQ ID NO: 389135 - DNA, 446 bp, Homo sapiens
cggcttgcagggcagcctgcttctaaattgtgggtaggggcagacttttatcttacctctgaagctgggagtttcagggggtaggttgagagctgacacgtatacacattaactcttctgcccagatcttcctactgctaaattaatctagcctaagaactcctttgcagcattgagaaaagcacagctcaaaaatcaaagtacaaacccagagaaaaactttccaggtagcaacctcaaagattgagctttacttttattttttatgtattttgtaatgccccagaacagttggtcttgttaaaatcaagttgtataatagtcaccaacccttctgtatctcctgaccccacaggacaggcttggaaagggcaggagaaatgagggtggtatgtgatacacccagaaggctgagggggcccggtcaggagccaaatttacttctc

SEQ ID NO: 389136 - DNA, 329 bp, Homo sapiens
acctagtaaggctagattacaaggcagaggatcttacccttgcacattggaatcacctgggtcccatccagagggtctggttacatgtagggtgtggcctgggcattgggaagtttaaagcttcccagctgattgtaatgtgcagtcaaagtcaattgagagcatctggtgcaagagctgcctcctctgggtccactttgtagctgggcatttcttttagtaatttcagttgttcattatcagactgatgtgcgcactctgcttttaatgggctggccatttatttgttgaggatctgccatatgccagtgtggtgtgaggcactttaa

SEQ ID NO: 389137 - DNA, 274 bp, Homo sapiens
aaggaaggaaaaggagaaaaggaaaagacaagacaagaaaaggaaggaaggaagaaaagtaaaagaaagaagaaagaaagaaggaaaaggaaaaaggagcaatttatgagcaaactagaaattgggtggcaaataaaaatgagagcatcttataagtgaaccagcaataagaggtcctttacacatcacaagtaaggagtgagccagagaaccagtggggtcatgaaataaaaaggatgaaaaggggctaggcgtggtggctcatgcctgtaat

SEQ ID NO: 389138 - DNA, 434 bp, Homo sapiens
tatgtgccaggcactgtgcaaggtactttggattcataacccatttattccccacaatataaggtgagtgctatatccccattttactgataagaacacggaggttcaaaggaattaagctcagaaagcagaattttaacccaactttatttgattccaaagcagaaattgaaattttaacccgtctatttgtttccaaaactcttaagcattatattatactatctcctcacatttaaaataattgctattaaacagtgagcgctgtgaaggaggcatataatctgaatgccaggaaaggagtcattaagttcttttgggagaggggaaaaccagggaaagcttccaggaagaggtgacacttgaactgagctttgaaagatgattaagaatttatcagaacatagcatataacctgacagagcagatagatg

SEQ ID NO: 389139 - DNA, 574 bp, Homo sapiens
gtgcgtggtttgagcaacgctgcattggtgtgggaggcctggggagctgcatctgctgctactgagctcattgcctaatgcagacacctgagcaggggaagcatcacggggtgaggcctggaggctcagcatttcctggcagcatcctcacaccaaagcctgctatctcctgaagggcagggatacattgaaagaaaccacaccttcctctctgtctgtgtaggtgattgtttagtggggctcaagtacctgctaaagagacgttgttattcatccagaatatttcatgaactgatgctggcattccagctaaaatatcgcatgtcaacatgtctgcaataatctatttttgaacatttgactaagatgaaaaattctagtgccttatattcaggttttttttggctttgcatgttgatataaaatactgtttgtgttaaaaacaaagtgcaagttagtggttagaatggaatctatagaaacgaaatttaatcatcaaaataatggtcaacttgctgttctgaaatcctttttcctaaaatttcccaataaaaattagaaataggaataatca

SEQ ID NO: 389140 - DNA, 126 bp, Homo sapiens
tgctattattgtgtagggtcactaggggaagtcagacaatgagcacataaactagtttcagatagcacatggatggaccaagagtggtgagagttggaatatctgtgaagcttttagggtaaagtc

SEQ ID NO: 389141 - DNA, 724 bp, Homo sapiens
agtgaaactccttctcacaaaaacaaaaaaacaaaaaaaccagataactcacctgttcttcaaatacatatcaggctagagaagtgtccaaaatgggtcatcaaagccaggagctagcagtgagtttttggaagttgatatagagaatggaaactgggattgggagatggaaatgagaagttggtctgattaagcaatggtctgcaccaatttcaatgcttagataatagtatcatatactagcagcgtgttggtgtcagcgtgttaaactaataaaaagccagaatgtaacagcctgcatagccctaatgcatttcaccagagagccatgtggaagccaaaatcctcacatgcagatctggcatgaggaagcttcctaagcgtctctcaggtagcttggtacaagttctgcccaacagaggtgcttcatacaccaggcagcaagcctacccaaatgagatcccctggttgggaaggtggacgtacttcatgaacaaagcaaaggtagatggttgtgtgcaggtcatctcacatgaggtgtctccctggttctttgtgaaaccctctctggacctcttctggttttgaaatagctcattcatggattcattctattaataaaagtcaaaagtaaacacttacataatgcttactaggtgtcagccatggtgctaagcacttcattcatattaactcattgtctccatgccacaatcctattacc

SEQ ID NO: 389142 - DNA, 663 bp, Homo sapiens
cttaagtgaaaattcaagccacctcaggacttagtatgtgaagcgagggaagtgactctgtatgtgcatgtgtttgggagcgtgtgtgcatgtgtatacgtgtgtctgtgtgcatgttgtgtgtgcatgtttcaggcactccggaggttccagaccattaaggaatctgggtctctaactcaatcagtctgatcttgggatttcgatggctccctgatctcctcgggagattttccccagagcaaaattcccaggacctgctcctgctccctgccctcgccaggcccttccctctccctccctgagggctggagtgaggggatgaagctgcagtgcccccgccccttttcccgcagctggctggggccaaactgggtttgtccaagaatctggccacagagcataaacccagaaactcgtggctagtgtggagttcttgctgtccatgtctctttcccgaatccctttgagccacagagggggaaggtttttaaaacagttactcctgagtgcaggaaccaccttctcttgccaggctgtactcctcatttagtttaaactaaatcaagaataacttcctggggaacacgatgccagccagtgatcctgctcaacttggtccccagccccagcccccgctggccccagcacccgctgagcccc

SEQ ID NO: 389143 - DNA, 726 bp, Homo sapiens
gatcaaaactccgtctcaaaaaataaataaataaataaataaaataaaaaggttaaagtgggtatcactatgataaagaaataaaataaaacccacgtctggctctaaggtaataagactggtgttttgttttgtttcacaaactaattctgaggacatgtcaggaaaaggaagtgtttcagtcagtgtgtaaactctgtacacagccttccttggtgccgaattcagaggacagtgctcactgggatgcagaaaaagcctgcaagtctgtaggaatactttacaggcaaaaacattttacccaagggcatttaaaaaaaatctttaatcaagttctctagatgttagtgataaaacagaaatgggtcttccttactgagacctgaatacaaaacttattctaatacaatttcttttattggcatacctttcagattttgctaaacaatataaattttcataattactctgggtaagcattatctctaacaaatgaaaaagattactgacactaagttaaatgacttttcccaaatccttttggctagaatatggcaaaccaaggactaaaccacctcaggtcttccctttatccattgttctatgttcccacaaagctttagaacagtggttaatcacttacagtggtaagttaactagggtgcttataaaatactgaatcacaaaattgcttgatcttgaaaatgtgaacttcattagagggtg

SEQ ID NO: 389144 - DNA, 371 bp, Homo sapiens
ggttttgtggtttgttttctcaaacccaggcagtttgccaaacctcagcaaacagcgcaaacctatcttgttaccctgtagtcacttctcatccttgtcagtatgtgtggagcatttcacgcaattgtgatcattaaactcatactggtttctgttctgcgtttttcagttaacatcaaatattcttcctctgtttttttcttgttagtcatttttcttgtgttggatatttgggttcccacgtttttcactataaattatgctgctttgtattgctttatcatgtctcttatgattggctgaaattttactgtgttatagaggagagagaatgtgtagatacaggaaggcttgaataatatagagccatc

SEQ ID NO: 389145 - DNA, 719 bp, Homo sapiens
ccaagcaaaggtctggctgctgctggagaaaggataaattctctgttgtttcaaggctcctacacaaatacaaagcgcgatgctgttgctactggaagagaagtgaaaaaaaactgcttatgttcaagaccacctggacaagacttcttaactatgaaaggcagttttgttgctgtgtaggaaaagacaaaaatactgagaataggctctctccacattctctgagactcagagttaaagagactaatagaagtctcaatccccgagacaacctgatagaagcagaagcataccaattcccaggagttaatgctgtttactttagtctccgttgttcttttgcatacaatacctaaatctaattttaaaaatcacaagagacatgaataagcatgaaaaaaagaactcatcatcaagggagaaagcagtcaacagaaccagactcagaaatgaaacatattttgaaactatttgactaggacttttaaataattataatgaatatgttcattaatctatggaaaataagaacggtgtggaacagatgaagaattttagcagtaagatagaaactataaaggaaatcctgtgaaatgacagattaagaaaacatgatatgaaagttgaaaaattttttcacatgcttatttgcagactaaaggcattacagaaagttaactgtgaattagaatatattttgattaaagttttcccaaata

SEQ ID NO: 389146 - DNA, 384 bp, Homo sapiens
ctgaatgtaactgatttgatttattcctttcacttaaactgtgtaatgcctcagtttcatgtgtctacagaggacgctcacccttggcaccacctggaaagtgtaacagcagggcattgaggttctggccaaggagccatcagcaatcccattaccaatgcttaaagtgagtctcataaggcagatttggctccaagcaaaaaccacagctctattttcataaactaatttcacttgtttgccccagttaatattaataagcccagggctatatgcttctacttaccagagcacaaagataatagaataatagagtgttagatctgaaatggaccttggagatcttctagaccaacttctccatttgatagatgaggaaacagg

SEQ ID NO: 389147 - DNA, 107 bp, Homo sapiens
gcctcaattcactgaaaatgtatttcattttctaaactattgttgccatatcttgctagaactaaacataacatcctgcttacattctaaatgagaaacaataacag

SEQ ID NO: 389148 - DNA, 1407 bp, Homo sapiens
cttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtgggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaag

SEQ ID NO: 389149 - DNA, 488 bp, Homo sapiens
  misc_feature (26)..(26): n is a, c, g, or t
aaggtgtaatcagcctcattggaccnctggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaag

SEQ ID NO: 389150 - DNA, 1101 bp, Homo sapiens
tctgctttgttcgttcgtttggtgtgtgtctcgtgtctgtgcgtgggtgctgtctgtgtctgtcgcttcgttggctctacgtttaggtcgttgatgtcggtctgcggtgtctgggcttcgcttgacgtgctcttctttgtgtctttagttgcgtcgttcctcttagtcgctgtgcctctctggttgtctgctcgttcgtgatcttcctctccccgttatttttatatcaagtggggacgccgcgtgaagtattggtactgaattacgtcgcgtagcgacatcgttctgtctgttcccagcataatgtcttgtgtgggttgttgccacccctaccactcgcctcatcgttttgtttgttgtcttccttggtccggttcttcatcttctctttgggttgggtctgtccccttatgtgttccccccgctgccaacaggttggtgtgtgcttctctcgcaatatagttccctgcagctcgtgtttttgtttccttccacacctgcctgggtgtgttttaagcatgcgcgcgccccctccgtggtttgttgattagttgtcctcccttctttagtgtgttggtcgcgcctcgttcttcatataaaagtggggtgtggcgtgttgatttgtgtggcttccgctctccgtgagttgttttatatttgtgctgccgcgcccccccgtcttttttttgtttttttttttttttttttttttttttttttttttttttttttttttttttttttttttttttttttttttttgtttgtttttttttttttttttttttttttggtttttttttttttttttttttggtttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaag

SEQ ID NO: 389151 - DNA, 1353 bp, Homo sapiens
cttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtgggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaag

SEQ ID NO: 389152 - DNA, 405 bp, Homo sapiens
aatgcctgtgggaggtgcagcccacgctgggccacctggccagctcagggatcctgctggagatcgaggattgtctggtcggcctcttacaactctcagaacatcatccctgggagcagccctgaagagaccaagggtcagtggcggggctgctgagtggctgcctccctgacctggccagcatttcctgggcacactgcagtgtgtccacgtccctgggtgtgtaggtggctgcagagccttgtcagagcatctgggccttcagggatctgcttcctgcccactaccctcctcttgcctgcctgcaaatctcagctccatccctcatgggctgtgtgacctagagtgaataatgtgacctctctgtgccttggtttcttgatttgtacagcctgattaatcata

SEQ ID NO: 389153 - DNA, 843 bp, Homo sapiens
ggccggggtcgcggccgtggatggggccggggccaagaccgcggagttcgcggaggcaaggcccaggataaggagcggatgcccgtcaccaagctggacggcctggccaaggacatgaagatcaagtccctagaggagatttatctcttctcgctgcccatcaaggaatctgagatcattgactttttcctgggggcctctctcaaggacgaggttttgaagattatgcctgtgcggaaggagacccgcgccggccagcgcaccaggttcaaggcgtttgttgccatcagggactacaatggctacgctggtcgggttgaagtgctccaaggaggtggccgccgccatccgcggggccatcatcctgaccaagctctccattgtcaccgtgcgcagaggctactgggggaacaagatcggcaagctccacaccgtcccttgcaaggtgacaggccgctgcggctctgtgctggtgcccttcatccccgcgcccaggggcactggcatcgtctcagctcctgtgcccaagaagctgctcatgatagctggtatctacgactgctacacctcagccaggggctgcactgccaccctgggcaacttcgccaacgccaccttggatgctgtctctaacatctacagctacctgatcccctgaaggacttctggaaggagactgtattcaccaagtctccctatcaggaattcactgaccacctcgccaagacccacaccagagtctccgtgcagaggacccaggctccagctgtgactacaacatagggtttttatgcaagaaaaataaagtgaattaaagcctattactgtcaaaaaaaaaaaaaa

SEQ ID NO: 389154 - DNA, 492 bp, Homo sapiens
aaccagctgctttactatggggctaaatctggattgtgtatgtttctttttcatcccaatttctactctttttccagtaactggaagattccctgggggtggggagaattcgatttttatctctagccctctttgggccattattctcatttatgaaccaagcccttttgtgaaaggagttggcagtaggagaattgaagtacatctgatcttagtgttgattctatgataaattttttctccctacgatattcctgagattgagattctgatgtttctattttacagataaaactctgcaaagacaatgtctagcacttatatctccagtaactcctgtcaaggtttattgttgcttgttcatcattgcagtcctgactacaagtgtgattgcactttctattgttttgtcaggtaagttacttgttctccaaactgtacaatattctccatatgtttttgttgtcaataaatatttattaagctccatta

SEQ ID NO: 389155 - DNA, 1879 bp, Homo sapiens
agcttaactggtacatctggactctgatgagtgagaagtccaagcaaatagaaaagccacagccaaacgataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatttttcacacatttacaaaacaatttgggaggaggctggaaatcatcttgactgaagaccaccaatggcagcagttcatttgggcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaattgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaaa

SEQ ID NO: 389156 - DNA, 2467 bp, Homo sapiens
ggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttgggtgagcactctctctgaccaggccatgaaaagatcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttcctcccacctttcttggggaaacttgtttttaagggatgccactgtttttgtaacatgttgctcctagctcttagcattcatggtactgttgtaaccgtccagtgggttcactttgtctgctagatagagccgatttatcaagacggggattacaatggagaaagagtaattcacgcagagccggctttgcagataaaactctgcaaagacaatgtctagcacttatatctccagtaactcctgtcaaggtttattgttgcttgttcatcattgcagtcctgactacaagtgtgattgcactttctattgttttgtcagaagccagccttgctcagtttgcaactatggaggaactgaatttcctgaaaagatacaaaggcccttctgaccattggattggccttagaagagaatcatcccatcgcatttggaaatggacagacaacatggaatataataacatgcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaattgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaaa

SEQ ID NO: 389157 - DNA, 2511 bp, Homo sapiens
ggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttgggtgagcactctctctgaccaggccatgaaaagatcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttcctcccacctttcttggggaaacttgtttttaagggatgccactgtttttgtaacatgttgctcctagctcttagcattcatggtactgttgtaaccgtccagtgggttcactttgtctgctagatagagccgatttatcaagacggggattacaatggagaaagagtaattcacgcagagccggctttgcagataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatttttcacacatttacaaaacaatttgggaggaggctggaaatcatcttgactgaagaccaccaatggcagcagttcatttgggcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaattgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaaa

SEQ ID NO: 389158 - DNA, 1915 bp, Homo sapiens
gtatcattgggggctgttataccaggacacatggaggtgaagaactaaagcaaaatcgtgtctacttcacagttttgcctaaggctgggcttaattcttaaaaagataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatttttcacacatttacaaaacaatttgggaggaggctggaaatcatcttgactgaagaccaccaatggcagcagttcatttgggcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaattgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaaa

SEQ ID NO: 389159 - DNA, 1357 bp, Homo sapiens
ggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttgggtgagcactctctctgaccaggccatgaaaagatcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttcctcccacctttcttggggaaacttgtttttaagggatgccactgtttttgtaacatgttgctcctagctcttagcattcatggtactgttgtaaccgtccagtgggttcactttgtctgctagatagagccgatttatcaagacggggattacaatggagaaagagtaattcacgcagagccggctttgcagataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatgtatgttttgagacttctcatcttttgctgtgtttatgtatggttatgtgtgtgagttgtgtttatgagataagaaatgtagtatcatggaaaacttactgcaatatgaggtaagaaatctaaaccctttttatgctcttcagttggttagctgtgtctttgggaaagctttacctgtgatttcagttgaagtctttaatgtgacagtgacatttctcacaattttacactttcatccactgatttaaaactgctgaaatccctacttatagctgatgtgcaacaaaggttctacaatcataggaagccactgaggagctgatatccacaaggctgttaagcccactcttgcaggtgttgcatccatttacaataggaaagcatccagggaactcatgggaatctctccctcctaaagcttta

SEQ ID NO: 389160 - DNA, 905 bp, Homo sapiens
ggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttgggtgagcactctctctgaccaggccatgaaaagatcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttcctcccacctttcttggggaaacttgtttttaagggatgccactgtttttgtaacatgttgctcctagctcttagcattcatggtactgttgtaaccgtccagtgggttcactttgtctgctagatagagccgatttatcaagacggggattacaatggagaaagagtaattcacgcagagccggctttgcagataaaactctgcaaagacaatgtctagcacttatatctccagtaactcctgtcaaggtttattgttgcttgttcatcattgcagtcctgactacaagtgtgattgcactttctattgttttgtcaggtaagttacttgttctccaaactgtacaatattctccatatgtttttgttgtcaataaatatttattaagctccatta

SEQ ID NO: 389161 - DNA, 358 bp, Homo sapiens
ctctctctgaccaggccatgaaaagaaaaatctgtgcgatgcctccccacatgtcacgggactctgacttgcctttgtcgtcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttc

SEQ ID NO: 389162 - DNA, 2008 bp, Homo sapiens
ggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttggataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatttttcacacatttacaaaacaatttgggaggaggctggaaatcatcttgactgaagaccaccaatggcagcagttcatttgggcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcatcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaacaatatgagtctcttaaaatattgatttgttcttagtaagattacaagaggctttgatttttaattctgcaatgtttccttaacagccattctgaattacaaactaattcctatttctgccacattccttcctgagaactgtctagtcctggtttgggatttatcttaaaggtctagaaaggcaacattttacttcagcaaaacttgattctatattgttgttttttcttaatgtgtcaaaattgttttgttactaggatttcctatgttgttattaaatgtattcccctgatcaaggtcactggcctagaaaacaaagattctgtgttttaccaagataattcccagtgcttcatggtgtctttattaggctttgactgcttagggaaactgagccttaaaagggtaaaagtttttccatccatgtaactttctgaggtctttaggttgtcactctgattaaatgagtagtattcttagcagtgacttattatctgttgaaggaagtattttaagctttttgacatctttggcaggtttctctagaatccaaatcctaaattaagccttttggcctaaaattgactgggatttttccaggtggaccccctagatatgctcctccaaaggcttgtctttcttgtagagttattaaatgattaggcttatttggcaaatactgctagaagcattgtcaaataagaaatggtgttttacctttctttaagctgtgtttgtgtaagttcatcatttatagaaatgtgaaattttatgagattcctaagatactgacatgctgagatacctgtaataattgcaatttttatgttggatgattgtatgccacagaagcacttaaatttcctggttaattggtaacgttaatcagatctttacctatggctgttctgggtttttgtcattcacagttattattttaatttcttctttggaagcgttcgcaatcagctatagtccaaaattgctaattaagatcaagcaaaacaaaattaattacgtaaaattaatttataaggatgtttttatgacgtaaatgttttattttccagagccaaggaaattttctgtcacaagctatctaccgtttgcaataatttgataaataatcctttgtgaacaaa

SEQ ID NO: 389163 - DNA, 603 bp, Homo sapiens
atttccttccattttagatatataatctgtgtgtagtagaatatatggtgtatatataggtgcttactaaatgggtgtggaatttctggctttgaattttaggattttggactactttaagggcactgagatgacaagaatcatctgccggacttttgtcctccaggtggagttctgtatgccagtcttcagttactctcctcagccctttaataccactacagtgtttgagcacctctacttggtataaggaaatatggcctaattgttacagagaagatataacccctactcttccatatcaaaaaatcacaaaagaggcagggaaaatttagcatggaaagctaccatagagttgtagtgataaattagctttccctctcaacctcagcctttcaagaaggaaaggctttctttcctactgtcttttgatacatttctttcctactctgtttgatacatctgtgttctccctttgattaaagaggagctgttcaacttgaacctggggttgagtactcagatctgcctatattcctaaaatagcaaagatccttacccagaaagaaatgacattagacctacaaaaattagccgggcgta

SEQ ID NO: 389164 - DNA, 359 bp, Homo sapiens
tactacactctataattatgttactgatctggttactgtcacctgatataattatttaatgtgcctggcttagtgtatgtagttgtgcagtaaatattcattgaatgaataaacgttaaaggttatgaaactgtgacgtaaaaatcttatgaataaaaaatggaagatgggaaaagtcagaaacagcttcattacatgtgtaaaacacaaaccaattatgtccaaagaaaagcaaatattatttccacagaattaataatttaatattatgtgaagtcggggtcattgaatacttgtaaattggcaattgattctcgatatattcctttaaagttataatcttcttgaagtttaaggga

SEQ ID NO: 389165 - DNA, 1445 bp, Homo sapiens
gcaattgtttcatatattttgtcttattttgcaattgtttcaggagggaggataaatatggtccctgttcctctatcttgaccagaagcatctaagaaggcagtgaagcaacatgtgtacagttcttagggaaacaaattttgacctaaaaatattaaacctagtcaaaatattattctagtacaaaggcagcacatgggtatttttgaacataaaagagttctagaaatacaggacccatgaatcattcttgaagaaaagttactcagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggttaaattacagtgagagagttgcacttatttagtttgcataccgtactcaactcttagctagcatagggcaggttccttagttgaaaaatttccacaaaacatgatgtaaagtggaaagatcagttcccccaaagaatatcagttaccaaagtaggatgaaaggatgttgggtagatcaaaacaacaaatgtccattacagcaattaacaaaagttagggaatggggaagtctgagtgctaatatggatttcaaaacaactttaaaaatggcttcaaacattttatgctttttgtaatttagtcattttaatattagataaatcttcctgtaactgaaagttcttgagttaaagaaaaatattcggtagttcagctcttccttcaattttattagttgctttttcttttgttcaagtgaaataaacataaaaataattttaaaatattatgtatcatatccttcgatttaacataattctatctagctgttcttatattttctctgatatatttttaaaagctttctggaatattattaaccttgaatatttctagttgatgagtttatgagtgatttattgcttccttttctctttcagtattgctagaattaattttattgactttgcccctttgcataaagaccttgaaggtcacatgctgaaatcgccctctactaaaacaaactcatagaaataatggggaagatatttcaaaacattgccatatgcatagccatcctcacaaccaagaaaagcgcctctccatgaactaaaacctatgagtcattg

SEQ ID NO: 389166 - DNA, 1094 bp, Homo sapiens
gcaattgtttcatatattttgtcttattttgcaattgtttcaggagggaggataaatatggtccctgttcctctatcttgaccagaagcatctaagaaggcagtgaagcaacatgtgtacagttcttagggaaacaaattttgacctaaaaatattaaacctagtcaaaatattattctagtacaaaggcagcacatgggtatttttgaacataaaagagttctagaaatacaggacccatgaatcattcttgaagaaaagttactcagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggttaaattacagtgagagagttgcacttatttagtttgcataccgtactcaactcttagctagcatagggcaggttccttagttgaaaaatttccacaaaacatgatgtaaagtggaaagatcagttcccccaaagaatatcagttaccaaagtaggatgaaaggatgttgggtagatcaaaacaacaaatgtccattacagcaattaacaaaagttagggaatggggaagtctgagtgctaatatggatttcaaaacaactttaaaaatggcttcaaacattttatgctttttgtaatttagtcattttaatattagataaatcttcctgtaactgaaagttcttgagttaaagaaaaatattcggtagttcagctcttccttcaattttattagttgctttttcttttgttcaagtgaaataaacataaaaataatttta

SEQ ID NO: 389167 - DNA, 927 bp, Homo sapiens
gttaatatggccagtttgaagggtggtggcggaggtattgagcaggcagctcagggaaatgccagggagacccttgagcacagaaactcctgattgtccccagggactctccgtggacacaggagggattttccaggatttcacatgaattcaatgaagggggctgtgtcttattcctggatgctttgcctccttcatggaattcagtggatttaatggaagttcctaggcaacaataaagagtagaaaccaggttaacagcgagggcctcatctcacaccagatcatatcaggctacacaaaagtagatggaagacaccacccaggcctccagctatacactggagaagaagccaaactagtctacttcatctaagaaagttgtcaaagagagcccttctatactatcttaaggtaaaaagaaagactctacccagctgccctgattaagcattagaaagataagtgttctgatcattaggcgaaagacaatggggaaaaatgtagaaaagaaatatgacatgagccagatgaagaacccatcctgaaaggatatataactcaggggacaaaagacaactcaccataagttgggcgcagtggatcacgcctgtaatctcagcattttggtaggccaaggcaggtggatcacctgaggtcaggagttcaagtccagcctggccaacgtggtgaaatcctgtctctactaaaaatacaaaaattagctgggtgtggtggtgcatgcctgtaataccagctactcagaaggctgaggcaagagaattgcttgaatcaaggaggcagaggttacagtgagccaagatcaggccattgtacttcagcctgggcgacaaagtgagaccctgtctcaaaaaacaaacaaagcctccccatagatgtctcctgccatagaagaatttaagaagt

SEQ ID NO: 389168 - DNA, 711 bp, Homo sapiens
gttaatatggccagtttgaagggtggtggcggaggtattgagcaggcagctcagggaaatgccagggagacccttgagcacagaaactcctgattgtccccagggactctccgtggacacaggagggattttccaggatttcacatgaattcaatgaagggggctgtgtcttattcctggatgctttgcctccttcatggaattcagtggatttaatggaagttcctaggcaacaataaagagtagaaaccaggttaacagcgagggcctcatctcacaccagatcatatcaggctacacaaaagtagatggaagacaccacccaggcctccagctatacactggagaagaagccaaactagtctacttcatctaagaaagttgtcaaagagagcccttctatactatcttaaggtaaaaagaaagactctacccagctgccctgattaagcattagaaagataagtgttctgatcattaggcgaaagacaatggggaagtctgagtgctaatatggatttcaaaacaactttaaaaatggcttcaaacattttatgctttttgtaatttagtcattttaatattagataaatcttcctgtaactgaaagttcttgagttaaagaaaaatattcggtagttcagctcttccttcaattttattagttgctttttcttttgttcaagtgaaataaacataaaaataatttta

SEQ ID NO: 389169 - DNA, 667 bp, Homo sapiens
tcccaggctgatctcctgacctcaaatgatcctccctcctcagcctcccaaggtgttgggattacaggcgtgagcctagctcattttattttctattctttgaaaaaaggcgatgggtttctatctctagtgttaagggtccctatcagctctgagatgcttttggtttggtttttttgttttgtcttgttttaatttttggtagttctcgatggttctaaagggtagttgattcattttagttagataaaatgggctgctgaaataaaatagggcactaaaagaggaaatattgttacctaggaaaatgttttgtctatttgctttatttattttatttgatacagtatctatttgggcctctaaaactcaactctgattcttttttgtaataattattttaaaggagtttaaaggcaccagctttttgggggagttcagggagtaaaaggaatctcttcaaagatacaggcaaaaataaaaccttgaagtaaaacttaataaatatatatgtttggattcatttgttttatggtaccattttgaggggaaaaaaatgtttccagcttcgttatgtagtctactgacttgttgggtataaccataaacctgtttataatatcctgactaaggctttttagagttactatgtttccaggagtaaata

SEQ ID NO: 389170 - DNA, 246 bp, Homo sapiens
gggagggaggctgcttatgtatggaggcagtcaggcaggtaaacaggacagtgggagccaggtttctctgaggagttagacacagaaagaagaaaacaagaacgacctctgtccactgggagcacctgggaacagtgacaccccaactgcagtgagcacccctagacccagacctttgctgctaaaagtattattctccactaaaaggagtgagggctgattccggggctaggcagggaaaggaca

SEQ ID NO: 389171 - DNA, 584 bp, Homo sapiens
atttccttccatttttaaaaaactgaaagcatttaacgtaagactgtgaagtacaagtttgaacatacatcattggctttatttataaaatatagtataaatattatttaaactttaaattctatacccaaactattcatcaagtatgagggaaaaataaacacattgttaaacatgaaagtcctcaaaaaatggcagattgaaacatacagcatttatcaggcaccctgccaaaacctttctaaaatggcagtaaaaaaggtgttttgtttgtttggttgtttgttttgagacagagtcttgctctgttgcccaggctggaatgcagtggtgtgattctagctcactgtagcccagaattcctcggttcaagtgatcctcttgcctaagtcttccaagtagctagggctacaggcacacaccaccatgtctaatttttaaaaatttttgtagaaatggggtctcactatgttgcccagaccggttagtttttaaaagacataaatgcacagataaataggtagggccaagccaagccctggagttcaaggccagcctaggcaacatagtaagaccctgtgtca

SEQ ID NO: 389172 - DNA, 440 bp, Homo sapiens
gttgaatcttggctcagacattgaacagttatgagattttggacaaataaatgtctttgactctgtgtttttgttttccatctgaaattgaggattacttatctattacctaggctcgtgggtattaattggaagcatttatatgtaaagccatgaaatattgacaaagtaataaaccttatggaccatgattttcatttagtgattaaatgtctgtagctaagttattaatgtttttggacatcagccataggaaaagttaacaagattggtttaagctcaccactctcagtttctattcagtaagttagtagttgatactctgtttaggatcatcgtttttgaaatataaataaagtagttttgtaactcatgaattcatggaatatgattctcggaaagcaggtttttcagcccttaatcattagaaaaggttctac

SEQ ID NO: 389173 - DNA, 718 bp, Homo sapiens
ttttttaatgggccatgggaccaagctagaacataccaattatactatattcaaactttgattctcaagtcaaaatctgttacagaaatactgttgctgtgggtgcaagcaacctaataaatactttcaacttcatttcacaaaaagtgacctagaatgctgatttagaaaaaatataagcttaaaaatgacgctatctgcttgtatgtgagagagagagagatggagagagagacagacgatgggcggaggggaggaaagagctaggtagaatgataaatgaaaatctaaaaaggcgggcttcatttcactggtattaatttggtaaattatccataatttattagagcttgtaaacattgtggcaaaattttttgcccctgtcagtaatgaattgcctacatcattaattttgtcaaaggatcaagaaacaacattgctgagctcaaagaaactcctagatgaatgaatatagttgggttgaagtgctggtgtggttagttgaattcagcagttgaatccacatgaccgtttctttcctcatggtcagcctgacctcaactgccaagggtggcagggtgcgtcccatcccccagtggggaggaggctgtgtagtcaacactgcattcggttccttacgtttccctgtgacactgtcctggcctgtatatatttatatattcacttacttcaggcatgtctaaagtggtaaatgaaa

SEQ ID NO: 389174 - DNA, 169 bp, Homo sapiens
cactttgaaataagaaagtaaattaaaatgctgcatttcaaaagctattaaaatactcaataatattttcataaggtatttcttgatcacctatattgcagcttccctcgggttacattctaagtcctatacaacttcagggaagtatgttaccaacagtgcctctcaa

SEQ ID NO: 389175 - DNA, 1061 bp, Homo sapiens
cctttaagtagtcatgtaattcattatagcagctgaacatttctaagtgcaacattataggaaaccagtaaagctgatttctgatttatctgcagcaaaagaatttaatattccaacttcagcaaaaggcaattaaaaacaaacttaaatcacattgtgtgcttttaatacgtatgtttttttccatgctgtctgatgtattttagttcttagtcatttacttccattagtttccaaattggttgagggaattaaattggtagccaagttacctatacaagattttcctactgtgtatgtgaaccactctttctgggaaaatcctcccgttggcacttttcttgaaggcatgcactttttccacacttagtgatttggggactgaagcctgcatttagcctgtatttagtcagaggtgacaaatggctaaattttttttttccagtttagagattgagaaatgattcagaattgaaactaaagtgaatttggacttactgtatttctttgcaattacttttaaacaattgctgtctgttactattaggcatattttggacctatgggttccattttgggccgatatttggtgttatgttgttaaatttcttgcctggcttagatggttcattgttgaaactaaactggaactaggtttgatcagagggccaatggaaatgcacgttgtggcccatttggggaggacaaaatttgacatatttttactttaagaattcttaggaaaatttggataacgtgagaatatatttccaaagggttaagtaattttcgagggaaaatcagaaagcttgtaattcctactgaaaatattagcctgctgaaatattagcctatttcctactgaaaatataacattagcaggccgggcacagtggagttcacgcctggctaatttttgtatttttagtagagatggggtttcaccatgttggccaggctggtcttgaactcctgacctcaaatgatctgcctacctacgcctcccaaagtgctgggattacaggcgtgaaccactgtgcctggcttgacttttttattta

SEQ ID NO: 389176 - DNA, 345 bp, Homo sapiens
catccttattggtagaaataattcagttggattctgaggagcagttgaaagagagatctcaggctgggcatggtggctcacgcctgtaattgcagcactttgggaagctgaggcaggtggatcaactgaagtcaggagttcacgactagcctggccaatatgatgaaaccctgtctctactaaaaatacaaaaattagccgggtgtgatggtgcatgcctgtaatcccagctactcgggaggctgaggcaggagaattgcttgaacccccgaggtggaggttgcagtgagttgagatcacaccattgcgctccagcctgggcaacaagagcaaaactcggtctca

SEQ ID NO: 389177 - DNA, 750 bp, Homo sapiens
ctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctac

SEQ ID NO: 389178 - DNA, 614 bp, Homo sapiens
ctctctgacctgccccctaaaatacttccacagtcatcattgcataccacaagtcccccagcaagattattttaaaaagaagatgctcgccaagacaagcaatcaccagaatgcacagaaaaatatgaggacctttggtttgttcctccacttggtaaaactcagaaagataatggcctatgttggcaacggtatgtgaagggaaggaggcgctttgggcactgctgaaggcagcacaaactggtgaggaatgtgcaacagacaatttggcaatatttatccaaattgattatgtgttctcctttggacccagagttcctatacttaacacctgttttacagaaatggttttgtatgcccccaaagagatttgttcaaggacactcatgatagcaatgcatgtcagaggaaaagaagaaaaaacaaaagacatatcctaagtatgctctttatttcacaccaggatttgatcaaatggtccataactttacctgccatttattttccccccagaacttcaactcaccttcctttctgtgctgccatctctagaccataagttgtccattttctctgtgtctagacccaagctgctgagttctactaaaaaaaaa

SEQ ID NO: 389179 - DNA, 331 bp, Homo sapiens
gataaatccaaggactgaaacaaaacagtactaaggatctgcgaactatcccgttatgaagaaatatgcatttaaaataaaattcaaacacatagacactgaagatatttggtgaaaaagactgagaggtctttgacctcttggaactcacagtcaagtgtggggtgtcaaatcaaacacgaggaaacaagtgaaagtgaccattttagatagtaagaaaatacgtcaaaaagaagtttatgtgatacagattgccaggcgagggctaggttaggcctccagcaaaagtctctctgaggaattggtatttggtagagttgaataatcatga

SEQ ID NO: 389180 - DNA, 410 bp, Homo sapiens
cttcaggcctttgcaggtgcttttccctctgcctgggtcactcttcccttcgcttcctgtggctcatagtcttttcctccaagtcttaactcccataacctctcctccaggaagccctccctgacctccaggctgagtcaaggccccctctcctggggtccctccctccaactctgccaatctgggctcatcattgtctggggataggtttgtctccctcattgggttgtgagctgggtgaaagctcggccaaaaccatcccggtcactgccttgtccccagcatagcacgtggtacccaataggtggttattaaatatttgttcaagccaggcacagtggctcatgcctgtaatcccagcactttgggaggctgaggcaggagaatcacttgaggccagtttgaggcca

SEQ ID NO: 389181 - DNA, 327 bp, Homo sapiens
aaaaaaatctacattgttttgagtgtttggttattaatagtttatggatataactgctgcacagtagtaactccttcatctactggaaggaaggtcaatttttcagtcattagaaataggtagctaaatgagatgcttcttatttttgcttggaggtgccaggtttatttgccaactttccacagttagaaagcactttggatcaccactgtcagatatttagatttctttttgagtctggaggattgtatttcttatcaaaacaaatatccaagtttatgctttaaaaatatttaagtttttattaattgcagaatatgagaataa

SEQ ID NO: 389182 - DNA, 945 bp, Homo sapiens
atttctccagagaagtatacattggtcactaagcccatgaaaagaggctcaatattaacagccatgagggaaacgtaaatcacacccacaaggagatgccacctcacaccgagtaggaaggctgtcatcataatcacagtgaggacatggagagactggatccttcaccccttccaggggcagcgcgaagagagatggagtcggggtggagtgtgggcgagagtgtggtctgcagggctgtgatggtgaatattaggtgtccagtgtggatggtcaccataccatggactgccagcggggctagaggagagcaggcgggagagggtgaggtgactctgcgggtggagctctctggcttctctttgcgttccctgagagttcttgcttccttcctccttggacatcagactccgggttctttggccttcgggctctgggacttgcaccagcagtttccgactttcggggtctctgggacatttggcaggggctgaaggctgccctgtgggcttttctggttttgaggctttctgacttgcactggcctctgctggcttgtctcctccccagcttgcagacggtctaccattggactttgccttgaaatcgtgtgcaccaattttccctaataaattcccgttcatatataacaaaaaaaaaaaaaaaaaaaaacaaaaaaaaaagaagaaaaaagacacgaagaaacaaaaaaacaggggggcggggccaaaaagaagtcccccgggggggggacccacattggagacacacaccggtgtatggggagcaaacgggggcccacacagggagaggagtctcaacaaagccatgacgaagcgggccgcgcctaacacacggcgagtgcggcagaacacgcagacgggggcaacactcgagaggagagcaccaaaccagggggggggcaaaatggtgggaacgccaccc

SEQ ID NO: 389183 - DNA, 239 bp, Homo sapiens
attaggccaggggggtggagctctcacaatgggattcctgctcctttgcccatttcctgccatgtgaggacacaggaaggtgactgtctgtaacccagaaaaaggtccttgccagtcaccaaccaggctggcacccagatctcagacttccagccttcagaagtgtgagagataaatttctactgtttgtaagccacccagtctacgataatttgttacagccacctgaatggaccaca

SEQ ID NO: 389184 - DNA, 362 bp, Homo sapiens
tcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggat

SEQ ID NO: 389185 - DNA, 724 bp, Homo sapiens
gtgagctgatagatgtaaccgtgttccaatgaaactttatttacaaaaacaaggagtgggtcagatttggcctgtgggtcatagcttgctgactcttgttttatttggtgaatggtttctgagagttgagtaacaactggggagtagagtccatggaccaggataaactttcatctctccccataatgggaatgtgtgagtaggcaggcgtgcatacctgcaacgcagcggcaaagctatggacttcctgtgttaagttcaatgtgtaagcatactcttgagagtaaccacgtgaactacgtaggtatccattgccaattaacatttggcaatgttaatgccaacaattaacatgaacataaaatggtctaattgtaggaaatctgaaaaagagaagacaaacaaagaaactgagacagaaagtggaaatgaaaactccggctacaattcagatgaacaaaagaccacagacaccgcttctctccctcccaaatcctgtgaatccagtgatcctgaacaaagaaacagtagctgtggccctcctcaccagcgggctgatcaacgtccacccaggccagcaagtcatccacaggcttcttttaatctggccagtcctgagaaggtcagtaatacaactgtagtatagcaaagccttccccaagctccactgagcacttggctgacaattcaaaacacggcgatggcatccttcctttccatccta

SEQ ID NO: 389186 - DNA, 289 bp, Homo sapiens
gttcctctccgtaccttaattttatcttaacagatgagtgaagctctcttttcaagtttgcattttacagtgatctcaacccattaaattgacttttttcctcctctgttgccagcgggctgatcaacgtccacccaggccagcaagtcatccacaggcttcttttaatctggccagtcctgagaaggtcagtaatacaactgtagtatagcaaagccttccccaagctccactgagcacttggctgacaattcaaaacacggcgatggcatccttcctttccatccta

SEQ ID NO: 389187 - DNA, 228 bp, Homo sapiens
atccagctaatttttcatatttttggtagaaatggggtttcaccatcttggccaaactggtctcaaaatcctgacctcaagtgatccaccttcctcagcctccccgagtgctggaattagaggcgtgagccaccgcgcccagctgaaagaagatttagttgagagctaaggtgcacataaggggacaacaagttagaggtgttcatacctaaagagctataatgtcct

SEQ ID NO: 389188 - DNA, 609 bp, Homo sapiens
  misc_feature (607)..(608): n is a, c, g, or t
gtctcactgtttcccaggctggagtgcagtggtgtgatcatagctcactgtagtctcaaactcttgggctcaagcagtcgtcctccctcagccttccaagtagctgggattataagtgcaagccacaacaccaggctgataggttttttttaatggaattttttcagatgtaatttacaaccatacagtttacctgctttgggtttacaactcaagatttttgtaaattcacagttgtgtggccatcaccacagtccaattttagaaaattttcaacgcccgagagaaattcctcatgctcatatgcagtcactataaaagtttttattaatgattgatgcatgtaattttcagtaataaaatcaagtattaataatacattttaatatgactcttttctagccaaagcatgtttcataccaaaagtagttaatttctcactcatttaaaaaatggctgggtgcagcagctcatgcctgtaatcccaaagtgctgggattataggtgtgagccactgtgccctgctgaaagatcttatttttataatattgatgatactctgtagcacataaactgaaatatattgtaatacactggatgaaaaaanna

SEQ ID NO: 389189 - DNA, 487 bp, Homo sapiens
ttcaagttcaacaccaccgtctagcacagtctttttttttgagacgtagtctcactgtcacccaggctggagtgcagtggtgcaatcttggctcaccgaaacctcctcctgggttcaagcgattctcctgcctcagcctcccaagtagctgggattacaggcgagtgccaccatgcctggctaatttttgtattttaatagagacggggtttttgccacgttggccaagctgttctcaaacttctgagctcaagtgatcagcccggcttggcctcccaaagtgctgggattacagatgtgagcgcctgcgcctggcccgcatggtctttattgtagcagcatctctgccctatcactgtcgcaggcaggctggtggctggcggggtggtctttagcaggctgctggctgagcccacatggaccagcagatgcccttctctgagcccttaccaagcacaccaagggtgtgccccctgacacacatgcg

SEQ ID NO: 389190 - DNA, 777 bp, Homo sapiens
tctcagtgcctctttcctgggccagatgtgcagccaccgcctgttctggggtggcacggaggaggaggaggaaaggatactgaggtttagcacatttaagtttggaaactgttcgatgccatccctgacagttcaccctaggatctgggggtggagagtgatgacagaagcgggcaaataatctgtgagtctttcagccgttgctgtgtgccccaccgtacacatacccttttctaatgtgtgccaaacagtgaaatctaatgataatagataaggattgtaggaagaaagcaatctagaaccgattatttcttttctttcttcagaaataaccgttaggtgaggaatgtgatttgaggtgcaccaagaggggtcctcagtttctaaacactgccccccagacccccaatacacacataccctgcctctacctccacccaaagagaggactcaatactgaggtcagaactcctctacgtgggactatagcaaagaagaacgcaggagaggggacggtggctggggacacagcagatgggcactgccaggcaggactgctgtgggcattgccagggagagccaggatgcaaaaatggcagtgagggggccctggtaagggcttctagggctttgctgatctccaggctcatgcgagggctgactagcttgggcagacagaccttttttcttttttccctccaacagaaacaaaaggataaaatcattggcatcactgctggacatggtggctcacgcctgtaatccctgcactttggg

SEQ ID NO: 389191 - DNA, 281 bp, Homo sapiens
acattatcacaatagaggcagaaaaagcatttgacaaaattcaacaccctttcatgataactcccaacaaaataggtatagaaggaatgaatgttcctcaacacaataaaggccatgtgtgacatgccaataactaacatcatactcattagtgaaaagttggaggcttttcctttaagatgaggaacaaagtgaaggatatattagcccaatttgctcattctacattgtatacatgtatgaagcatcacattgtaccctataaatatacacaatggtca

SEQ ID NO: 389192 - DNA, 469 bp, Homo sapiens
ctactatggagctcacattctcctgtcacttcttagagacttctggcttcctgtcaggcatataacaagcttgaaatttgtcactcggttctaacagtaagtaaaaagttgaacaaactcaaaagtcaacaactcattaaaatccctcagagatggctgggcacagtggctcatgcctataatcccaggactttgggaggccgaggcgggcacaaggtcagaagatggagaccatcctggctaacatgttgaaactccgtctctactaaaaatacaaaaaattagctgggcgtggtggcggatgcctgtagtcccagctacttggtaggctgagccaggagaatgccgtgagcccaggaggtggagcttgcagtgagctgagatcatgccactgcactccagcctgggtgaaagagagagactctgtctcagaaaaaaaaatgctgttagagaaatgaagaatgctttt

SEQ ID NO: 389193 - DNA, 264 bp, Homo sapiens
caccaattcatgtattcatgtgacagaataagatttcagagttgtgtatgccagcgccaaatacaagaaacagataagggatagatatttctactgtatgcctaccttatttatgcctactttatccaaatcaacagaaatgagggcatagttgtttgtattataaacagatctgccatggggtttcttgaaatcatgagcccccttgtggtttctttttattattattatacatttttattttaaaatagtgtaggactcaca

SEQ ID NO: 389194 - DNA, 416 bp, Homo sapiens
ggagttttaccaaagatctctaaaattcttctgaaagaactgcaggatgtaattaagacaaaggaaaattatcccagaaggaatacctgagatgtaggatggaatagtaaacagatagaatggcacagtaaagccaaacaaacatgatataacgtaataattgtgtttaatttgtggaattaaaggcaaaaaactgcaatgacatgagttagtccatgttgaagaagtccaccaggcagttgtgagaacatgggagtgggccgataaggcagttatgagggctccattgtcagcaaacaagtcaagtgtaaactaagaacaaagtcacttagattgagaatacatgatgaggattagggctacctttggtgaatatatggtatactggaggctaactggaggctgcctttatgcaa

SEQ ID NO: 389195 - DNA, 1177 bp, Homo sapiens
  misc_feature (1025)..(1025): n is a, c, g, or t
  misc_feature (1029)..(1029): n is a, c, g, or t
  misc_feature (1031)..(1031): n is a, c, g, or t
  misc_feature (1036)..(1036): n is a, c, g, or t
  misc_feature (1038)..(1038): n is a, c, g, or t
  misc_feature (1042)..(1042): n is a, c, g, or t
  misc_feature (1045)..(1045): n is a, c, g, or t
  misc_feature (1053)..(1053): n is a, c, g, or t
  misc_feature (1062)..(1062): n is a, c, g, or t
  misc_feature (1067)..(1067): n is a, c, g, or t
  misc_feature (1071)..(1071): n is a, c, g, or t
  misc_feature (1073)..(1073): n is a, c, g, or t
  misc_feature (1079)..(1079): n is a, c, g, or t
  misc_feature (1083)..(1083): n is a, c, g, or t
  misc_feature (1085)..(1085): n is a, c, g, or t
  misc_feature (1093)..(1093): n is a, c, g, or t
  misc_feature (1095)..(1095): n is a, c, g, or t
  misc_feature (1177)..(1177): n is a, c, g, or t
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaccagtaaaaaaaaaangggngnctaananccgnggncagtagcncccgtttgnaaggnccangnggtaanaagngngggtaacngnggaaggcggttgagactctggggggcccacgacgcgaaaattgtcctggtggtaatattaaatgccgagatacagccctccn

SEQ ID NO: 389196 - DNA, 620 bp, Homo sapiens
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatcttcaacacggcattcccggaccaaaccttttaatttggggcccgggaaatggtccccaaattttaaacccaaaccaaaaaacccccttgtggggttggttccaggaaaacgttactcccaaatctaagcccaagatgcaaaagtttggttcaatgggggtagacagctatgatatctcaaaa

SEQ ID NO: 389197 - DNA, 1214 bp, Homo sapiens
  misc_feature (1062)..(1062): n is a, c, g, or t
  misc_feature (1066)..(1066): n is a, c, g, or t
  misc_feature (1068)..(1068): n is a, c, g, or t
  misc_feature (1073)..(1073): n is a, c, g, or t
  misc_feature (1075)..(1075): n is a, c, g, or t
  misc_feature (1079)..(1079): n is a, c, g, or t
  misc_feature (1082)..(1082): n is a, c, g, or t
  misc_feature (1090)..(1090): n is a, c, g, or t
  misc_feature (1099)..(1099): n is a, c, g, or t
  misc_feature (1104)..(1104): n is a, c, g, or t
  misc_feature (1108)..(1108): n is a, c, g, or t
  misc_feature (1110)..(1110): n is a, c, g, or t
  misc_feature (1116)..(1116): n is a, c, g, or t
  misc_feature (1120)..(1120): n is a, c, g, or t
  misc_feature (1122)..(1122): n is a, c, g, or t
  misc_feature (1130)..(1130): n is a, c, g, or t
  misc_feature (1132)..(1132): n is a, c, g, or t
  misc_feature (1214)..(1214): n is a, c, g, or t
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaccagtaaaaaaaaaangggngnctaananccgnggncagtagcncccgtttgnaaggnccangnggtaanaagngngggtaacngnggaaggcggttgagactctggggggcccacgacgcgaaaattgtcctggtggtaatattaaatgccgagatacagccctccn

SEQ ID NO: 389198 - DNA, 1352 bp, Homo sapiens
atgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389199 - DNA, 889 bp, Homo sapiens
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389200 - DNA, 1142 bp, Homo sapiens
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389201 - DNA, 985 bp, Homo sapiens
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389202 - DNA, 1040 bp, Homo sapiens
agggcggggtttgcgttggcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389203 - DNA, 1454 bp, Homo sapiens
atgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaatccgaaaaaa

SEQ ID NO: 389204 - DNA, 1197 bp, Homo sapiens
gtctgttcatctgtgcttttatcagctgctgctttgggatagtatttggcctcttaaagcctggattggaatcataccaacctaaatcatcttggcattgacaacaaaacagagttccccttgatatggcaacagggcttcttcagagattcaggatttcacagctcccacccctctgaaactgccttagcaaagattataatagtgtgaaaattatgacagtgaaagaaatctgacctaactggctccatcttgcttttaacctccaagcttccctcgttctttcctcaaagtaggctgaactaactttggaaggaacttatagtttaactgtttaacaacgttgatatcagcccctccccaaaatgaactccctcctggcttgggaagcacagcacctttgtaaaacaaaaaaattagccacaagattagaagttatggcttaagagtcaggcagccagaggccacaagattactaacctccccaattgctcctatagataacatgactgttgtaaaacataagattggtattcaaggtattttttagactctgcattctgatggatcagctggcaccaccaacaccaataaactggttcatctgtcttgtggcccccatctaggaacagacttggcataagaggagagcttcaactccctgtggtttcatccctgacccaaccaatcagcatttcccatttcctagccccctctgcctgccaaactatctttctaaaaccctagcctctgaacttttggggaggctgattcaagtaataataaaactctggtctcctgtttagccagctctatgtgtatgaaactcttcgttgcaattcccctgtcttgataaatcgactctatctgcacagcaggcaagatgaacctgttgggtagttatgcctctgcgtgaccactgatgataagatttggcactcactgaaaggcagtcatcttcaccactctccgactggctcagctattgttaacttctgttgattcctgttggtggcattcctgaaaaaaaatttgtatgctggcatttggaaaattgagaaaatgtgagtggaaggtagagcaaaaacaggtagagaaagaacaattttacttcttaggggtcttgtgttctccaggatattgttgccaatgtgggaactatcagaacagtcctcggatttgattaaaaaaaaaaaa

SEQ ID NO: 389205 - DNA, 331 bp, Homo sapiens
gacagggtttcgccatgttggccaggctggtcttgattgaactcctagcctcaaaccatctaccctcctctgcctctcaaagtgctgggattacagatgtgagcccctgtgcctggcctgttctgtttttaataatactaaattagcaaaacaatttttggatgttatatatttccattttaaagtaaaaataggctgggtgcagtggctcacgcctgtaatcccaacactttgggaggccgaggtgggcagatcacgagaggtcaggagtttgagaccaaactggccaacacggtgaaaccccatctctactgaaaatgtggtgtgtgcg

SEQ ID NO: 389206 - DNA, 523 bp, Homo sapiens
gatcacgtgcattgtgcataagtattatggtttcttacaaagtatgaaaaggtaagggcaatccttgtttaattaaattcaaaatgagtgagcagaacatatgtaaccagaaggacaaatccacccttccctttggtcaagcacatctgtgtgaagagacaacctgaacaggctaagtgtgagcaacaaggctgtttattcactcgcgtgcaagtgagctaagtatgaaaagggagtcagcagagggtggtgggattggagatggttttataggttaggggtaggcaatggaaagttacagttaggggctggattttgcaggtaggggaagaatgtcacaaggtacattatcacaaggttacagagcacagtgtcatgtgtcatgaggttgattgatcagttagggtagagcctgttacaatggtagaatgccccaaggctggctaatcagctaagacaggtactagccgtttttcttcttttgtggttttcctgttgtcccagattttctggctgcaggaca

SEQ ID NO: 389207 - DNA, 245 bp, Homo sapiens
cacgtataggggagggggagggaaatacacagactaaactatctatagggggaggtacacatacatgccaggaggtgtatatggtggaggggaacacacaaccttggctacatattgttgggggtgctcacgctggaatatatatgggagatacgccacctcaggatatacaggcaggtcataacatgctgggatatacgtgggggacagtacacaccaggatatgttggacacacatactggga

SEQ ID NO: 389208 - DNA, 332 bp, Homo sapiens
cagtgtaccctgagatactcagttcattttagttcctctaaagttttgttattaaaaagttactgtaaatgcattgtgtccagagcattatagcatacttttaaaaattattcacttcttaagaattctactcatcccaccctcatcttttgaaaattaacactttacctacatgacttaaaatcatctgaagacttttaataagttgctgagtttcatgtttcaaaacctgttatctactactggagcaattaaaattaaccatacaacaggtaacaggtttaagtgactttgccttggttttaactaagcacaggttttaagtttgtaag

SEQ ID NO: 389209 - DNA, 649 bp, Homo sapiens
acgcaacatcgcggcccatgatcatgccccaattcccctcacctctaaggcagccttctccttgccgcctcccgccttccgagcgtgtgcaactccagttgtccccgggctcccttccagcctcaggaccccatctcacacccgcctctcgcttcccgcttcccgctcgcctgaaccccgccgcctctgctccctgtcttgttccctcagcgtggccccttcctccagccgcgggaagtgggagacgctagcgggagcttcctcctcccggcgctcggaggaaaaggaaagaccaagtagaaagggtcgccgctgcggcacgcgagggagctagtcgccgggctccgcgctcccgcttgcgtccctccagccccctgggcctcgtccggggccggatcttctcgggcaccgcctggtgcgaggagtcaggactgcgacctcaccgacctcctcccatccccagcctgggattgggtgggatatctgggatctctgagcttgggtgtcaaaaaaatattgggggtggcatttatagtcactatcgtccctagcttgagggaggcgacggctgccttccgctcgccgccccccggttttcccggctccgaccctatcctctaacccgtttcctgcttcagctgaccacatt

SEQ ID NO: 389210 - DNA, 872 bp, Homo sapiens
gagaacagtgagtgttctaggcctgtgtagcctaagcgtgcagtgtggatagtctacagtagagtacagtgagtgttctaggccttcacattcacctgccactcgctcattcacggagagcaacttgtagtcctgcaagctccattcatggtcagtgctctacataggtataccatttttatctttcataactttcttttccttcatgagataaagtcatagtctgtcacccaggatggaatgcagtgatgtgatcttggctcactgtagcctcgaactcctgggctcaagcaattctcttgcctcagcctgctgagtagctatgattacagatgtttgccaacatgctgggttaattttttaagtttttctagagttgaggtcttgctatgttgcccagtctggtctcaaactcccggcctcaagcaattcccccaccttggcctcccaaagcattggaatcataggcatgagccaccatgcccaaccttatactgtatttttattgtacctcttctatgtttagataagtgtagatacataaatacctaccattgtattacaactgcctatagtattcagtacaagaacatactgtacaggtttgtagcctaggagcaataggcaatatcatgtagcccaggtgtgtagtagactgtctcatctaggtttgcgttagtgtgtctatgatgttgacacaaggacaaaatcacctaacaatgaatttcttggcaggtgtctctgttaagaagacatgactccagtactctcaggtgtaagctcttttccagtgatgacaccggcactccctacccccatccctctggaaaaagaatgatctaaaatgttatgatttaaagcaaaaggatatg

SEQ ID NO: 389211 - DNA, 423 bp, Homo sapiens
acgatcccttcgaatcgacggttctcagttcgggctgttcgatcttttctcctgatggcactgagatgcacatttctgacaacaccgcagaagtgacaattgtgcccttctcagtgcatcatatgggaaggtacatggtatcagtatgtcttattagtggtgatgttaacttgatcactgggttaaggtggtttctgtcaggcttattcactataatgactgtttttccctttgtaattgtatctgagtatattttgtataactgtgagtcttggagccatagtaatgtttctcatgccccccaaaataattaaagtcaaccaggatatgaggagagttcaaaatgaaatacaaacagtaacaaatgaacttaactgtatttcagatgcataatacaaccacattgaaggaggtgggcaagaa

SEQ ID NO: 389212 - DNA, 233 bp, Homo sapiens
atgccactgctatctcccacaaccctgagaccaagaagacccgtgtgaagctgccctctggctccaagaaggttgtctcctcagccaacagagctgtggttggtgtggtggctggaggtggccgaactgacaaacccatcttgaaggcttgccaagcctaccacaaatataaggcaaagaggaactggtggccacgagtatgggatgtggccatgaaccctatggagcatcct

SEQ ID NO: 389213 - DNA, 2827 bp, Homo sapiens
gaattccggggtggtctgagctggagccacgctttctgttggagggggcagctgaaggagaacagcaagacatatccggcggccctacggactcggagagctggagggaccccggagatctcaaagggacaggaaaggcagcagcagccaccctctctcccagtcaagtggtcaccagcaggactgaaggggacagcccctttgcagtggctcggcgaggagacccctgcaccctagggtcagtgcaggagcccagccgctgagccatgccgggtccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctacaaacataccaggctggtgaagaagccagaccaagcccgggttcggaaacaccagcgtaagttcctccaagccatccatcaggctcagaagctccggagtgtgaagatcgagcaagggaagctgaacgaccaggctaacacgcttaccgacctagccaagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccgacgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacctgttcccatcaccggcctagcctagaatcctagcctagaagccctctctccctctgggctggagctcagtgagggacaactctctagggacacctgtaccagccccacctggcgctgagatccctcagacagcatggcccagccctggccagaagcatcgctccccttcaaccaaccgcgttgatggacacccactgtgtgccaggccccagcggggcccatgggggaggtgacctgggtgaggaaggtcatttgggtttttgtgagatttgtattgagcacctgctgtctacagagaatgtgatgatgtcaattaccacactgattcctcatcagaacttgaccatggtgggatgggggggaaactgaggcccagagaggtgaatctacctacctgggaccacactgcgaggaaggatggtgcattcaaactggaaatcccctaggccaaagtaaagaaccggactggctgggca

SEQ ID NO: 389214 - DNA, 370 bp, Homo sapiens
aaaaatccgagcctgtggggtttcaggccaggctgacgtcactctctgggggcgcggtggggctgggcagggagcgcggcgcgtgtctgacacccatggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcaca

SEQ ID NO: 389215 - DNA, 349 bp, Homo sapiens
tggagatctgaacaaaatagctacctgggcatccaatccctctactgtgaaatgcatgattctccagaccttttccaacacgcatagagctttctgatcgttttagtgcctactcttaagtatgaattgaatcaaaggttgaccagacaattgaagaaattctccatcaaatgagactcaaagaatcagaacaaagtgtaattctgaaggaaaagaggtaagataaacagcagaagaaacgtttacaagactataattaatatattctgatataaccataaaacataaaaggatgctatcaaatagaagattgaccagagaacacaaaagaatatgagcaattgtaaat

SEQ ID NO: 389216 - DNA, 414 bp, Homo sapiens
gaaaagcttaggaccagtgacttcactgaagaattcttgcagccatttaaagaactaacaaaaatccttctcaaactcttgcaaaaaatttagaacaaacctccaaattcatttcagaagtccagcattaccctgataccaaaatcaggcagatactttaagaaacgaaaactacaaaccaatatccctgatgaatgtcgatgcaaaaatcttcagcaaaacactagcatgcttaattcaacaacacattaagagttacaccaattacttttagaatgcaagaagatggttcaatatatgaaaatcaaattaagacatcacattaacaaaataatggacaaaaaccacataggccaggggcagtggcttcatgcctgtaattccagtactttgggagcccgaggtgggcagatc

SEQ ID NO: 389217 - DNA, 300 bp, Homo sapiens
tctctttaaaaaatagtcaatttcatgagagttattgaggattaaatgggataatccataggaggtgcttagaagagcttttggcaaataatcagtccccattaaatgttagctgcccagctgggcgtggtggtgtatgcctgtaaacagcagtttgagaggccaaggtgggaggattacttaagcccaggagtttgagaccagcctgtgtgagattgtctttataaaaaaattttttaaaaattaggtgggcatggtggcatgcatctgtagtcctagctacttgggaggctgaggtgg

SEQ ID NO: 389218 - DNA, 230 bp, Homo sapiens
ccaactgcatttgtgagacagcaaaaagctatggtccagtctccttccattgtatcatctcatcaatgtatttctcccactacccttgtgtgaaatacaaacttttttggcttattgtgattatgcaaggtgtatgccaacttttttttttctccacatctttcagctttctgatgggtaaaaattttccttattttgctttagaaaaattctcattggcatagatctaa

SEQ ID NO: 389219 - DNA, 429 bp, Homo sapiens
cttttcctgcttctcctctagctcctccacttcttcctcctccctcttacccttcctctccttcttctcagaccttttcgtccaagaaagtcttaccaggaggctcaatgtgaacaagagattaaaaacagagctgctctgctggaggtggggtggggagcctgaagacttcttcatctgcctctcaccacatcccccctcctggcacctgaagaattctgcagagaccagtttccaagggctgtgtgggcagagtgtgcatgttcaggcatgcatgcctgtttgcagatggtatggagaaaaaggtgattgtattgttcataaaaatgtaacttgctcaagtatacgccccctttctttctaaattacttgctttgatattctgggttccctagaacttagattgaaatgtcatccaacaactatttg

SEQ ID NO: 389220 - DNA, 285 bp, Homo sapiens
gatagagaaaggagttcaagatggtggcccctttggtcaacaatgaggccaacctgacaatgagactaacctgctgagtttccaggttagaaaaattaggctgttaagtaagttaggtgagggctagattgtaaaggtttataataaaccatgctgatgactttacctttttgtgatttagaacagtgtagtgtagcagtatgaactgatatggtgaaaaagatgggtgacaagaagacttgattggaagactataccaattaattgggtgtttttgtttttgag

SEQ ID NO: 389221 - DNA, 310 bp, Homo sapiens
tcatgcctgtaatcccaacactttgggaggccgaggcgggcagatcacctgaggtcaggagttcgagatcaaccgggccaatatggtgaaaccgtgtctctactaaaaatacaaaaattagctggacgtggtggcatacccctgtaatcccagctactcaggaggctgggtcaggagaatcgcttgaacccagggggcagaataagaccctgtctcaaaaacaaacaaaaaaatttaactattctagaaaaactcaatgctaataaatagctgaactacagtttatctttcataagcaagagacagacac

SEQ ID NO: 389222 - DNA, 719 bp, Homo sapiens
ctcttgaacccgggaggcagaggttgcaatgagccaagatcgcgctactgcacttcagcctggtgacagagcaagacttcatctcaaaaacaaaacaaaaaacaaaacaaaacaaaattagccgggtgacgcatgcgtgtaatcccagcaacttgagaagctgaggcaggagaatagcttgaacccgggaggtggaggttgtagttagccgagatctaaaaaaattttaaaaaaaaagagtggatttggagctacgagacaacagctgaatagctatactctgacataagaatttaatttcttgaaatttattcaatggaaataattacgaatgtttgtaagtgatgttctccacagcattatttataaagcagtgcagtgaaaataataaaaacaactggccgggctcagtgactcacgcctgtaatcccagcactttgggaggctgaggcaggaggatcacctgaggtcaggagttggaggcttagtctggccaaaatggtgaaaccccgtctctactaaaaatacaaaaaaatttagctgggcgtagtggtgcacacctatagtcccagcttctctggagtctaaggcagatgaatcacttgaatcagggaggcagaggttgcagtgagccaagatcgtgccattgcactccagcctgggctacaagagcaaatctccatctcaaaaaaaaaaaaaaggaatgtagggaaggacat

SEQ ID NO: 389223 - DNA, 350 bp, Homo sapiens
tttcattttcttttttaggtaacaaaagacattttggctacttaaaaatgggaaggtatttactttttttaaaagtaaagaggccaggagtggtggcttatgcctataatcgcagtaccttgggaagctgaggtgggaggatggcttgagatcagcctgggcaacacagtgagacccccatctctacaaaaaataaaattagctgggtgtggtggcacacgcctgtagtccagctgcttgggaggctgaggtgagtattctattgctggagcctgggaggttgaggctgcattttgctgtgatcttgacactgcactccagtctggatgacaaagcaaaacctcctctga

SEQ ID NO: 389224 - DNA, 468 bp, Homo sapiens
aaatcaggggggcttgcagccatgtaaggatggcttttgcatgctaataaagggcaaagatgtggctagaatggggcgagccatgctgtcacctgggacatgctaaaaaactcattaatctaacgggtgcgatggctcacacctgtaatcccagcactttgggagcctgaggtgggcggatgacttgaggtcaagagttcgaaaccagcttggccaacatggtgaaaccgtctctactaaaaaaaaaagaaaaaaaaaaatcagctggtcatggtggcgggtgcctgtaatcccagctactcaggtggctgaggcaggagaatcgcttgaaactgggaggcggagattttagtgagcctagattgcaccactgcactcctgcctgggctacagagtgagactccatctcaaaaaaaaaaaaaaaatttccttgattggcattggtttacaatttcaaaataatttcgc

SEQ ID NO: 389225 - DNA, 1150 bp, Homo sapiens
gtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggtaagttgcccaga

SEQ ID NO: 389226 - DNA, 1522 bp, Homo sapiens
ctaagaaggaagcaaggggatgaaagtgctggtgaaagattaaagaatctctctgattatagctagataagaaaataggctaaggaagttgtgataaactggtcaagccaggcgcggtggcccacacctgtaatcctagcactttgggaggctggggtgggtggatcatgaggtcaggtcaggagtttgagaccagcctggccaacatagtgaaactccgtctctactaaaaatacaaaaaattagctgggtgtggtggcgtgcgcctgtaatcccagctaccagggaggctgaggcaggagaatctcttgaacccgggaggcagaggttgcagtgaggcaagattgcgccattgcactccagcctgggcaacgagcaaaaccctgtctcaaaaaaaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggtaagttgcccaga

SEQ ID NO: 389227 - DNA, 1181 bp, Homo sapiens
ggcggtacggtcggaattttgggatagataggggccgtgcgtgcgcgcaatgtatctcgaacgctcctatggtgtagcattgaagttcaatatgatgtcatggcatgcagctgtgcaccagtttggacgttcgcctctgtcgcctgaagggcacgttctgacgccatgagcattcacttgcgactcatcggaacgcgtcacgtagacctagcatccacattgttaccatctgtgatggataaagcgacactcggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggtaagttgcccaga

SEQ ID NO: 389228 - DNA, 1170 bp, Homo sapiens
  misc_feature (12)..(12): n is a, c, g, or t
  misc_feature (15)..(15): n is a, c, g, or t
  misc_feature (22)..(23): n is a, c, g, or t
taacgttggtcnccncgggtannggatatcgcgaccaggcgctcgggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggtaagttgcccaga

SEQ ID NO: 389229 - DNA, 1564 bp, Homo sapiens
ctaagaaggaagcaaggggatgaaagtgctggtgaaagattaaagaatctctctgattatagctagataagaaaataggctaaggaagttgtgataaactggtcaagccaggcgcggtggcccacacctgtaatcctagcactttgggaggctggggtgggtggatcatgaggtcaggtcaggagtttgagaccagcctggccaacatagtgaaactccgtctctactaaaaatacaaaaaattagctgggtgtggtggcgtgcgcctgtaatcccagctaccagggaggctgaggcaggagaatctcttgaacccgggaggcagaggttgcagtgaggcaagattgcgccattgcactccagcctgggcaacgagcaaaaccctgtctcaaaaaaaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacaatagtttcaaacaaaagcatacctcgaaagcgccccagagagtttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggtaagttgcccaga

SEQ ID NO: 389230 - DNA, 613 bp, Homo sapiens
aaagaataaaataaggatgtgtctgttataagataaaaagaagcttagttcttgaagtcccaaaggaggccagagcaagtcttagtctaggctcaaatatcctaaagcaatgattctcaaactttaacctgcatcagaatctcctggagggcttgttaaaacacaggctgctggactctgtctccataatttctaattcagtaggtctgggatgaggccccatgaatttgcatttccaccaagttcccagctcatgccataggtccaaggatcatacttccagaatcactgccttaagctctagaatgctatttcagctaccaaatatgaacacttacaatataccacactctatgctgagtgtactgagatgggtgagactcagttcatgcccttgaggagctcatagtctaggtggggaaacaaacatacacacacatgaatatatttatttgttgagaacagataagtaaacacagcatcggtgttctttctctggacctcagtttccctcctcatatcccaggcctctactagtgccattcattctactcactgtttcagcaggagagctgttcccagattatagttgataaggaaccttgagggatat

SEQ ID NO: 389231 - DNA, 857 bp, Homo sapiens
catgattatagctgaagaatctagatatttatgcttttaattgatggacatccactctatctcaaacaaagcaaacaaaatgaataaaagctgactctgtctcaaacaaagcaaacaaaatgaataaaagctgaccagaaagtgacactgggatctgatctaactgaggaccatcaaggtcaccctgaagtaacctatatcctctggcatcaagaacatcctcaattcctgaggggcctcagggcttcagaataatccaaggattactggtctagagccagggtagaattctcataggtgaaggactgcaccatttgaagaggtctttttctcacaccattaagtaccatgccaagttacttttttccctcttacttttcccatgctttcacgttatcaacacatggcagaggtacaaaagtgacttaagtcttaatgttcaattcagcagttctgaaaaacagattgcctaggacttgctatgtgaccttgactagtcctcaactgatccattaacttaataaatgtcttttatcatcactagggaaagggtaattagtcatcatgaaacactttattacaaagtactacgtaaatgctaaagaataaaacttagaagagaaagattaataagaaacacggtggggcacatttactggtaaatggaaacttaaaacagggtcttcccacattcctggcagagcctgcttcttttagctaatgcaatataagtctaaaatcatcagcacttggcctgacaataatacacattagtaatattcctcctgggaagaagagaggaaaagggatagttattcatggtaggtggccacatggacatctcagttactagttag

SEQ ID NO: 389232 - DNA, 422 bp, Homo sapiens
ttcagtccataacaggcatgctgcatttcccccggttaggtgcttttttccctggatgggtaatcccctacgcgtgcagcagggatgatcttctctgactagctcattcatgatactcaactgttagacatattttcttgacacggagagtttcttagatttcgttcgcaggcctttgctttgaaatctctctcgtctggtttctgtggtttctgtcttgtcagctcatcccttcaatctctctctctacttagcccctctacaagggcagcgtgttcagcatttgatttagcttcttccagatgctgcctcttgagcaggtcctttccctctgtgctctgcagcctgaggataactcgtacagccctaggctgtgtctaccactggcttggttgaggaccttgacagtcaagagagctggg

SEQ ID NO: 389233 - DNA, 363 bp, Homo sapiens
taggtcagttaaaccatttctaatatgtggcagataacaatctgtgctcagatttacagataagctattctgggattatttcgaaaggtaatgctcttttgggtggaggacttcaagattaatttgtgtactaattaacaagttaaagatcataccagaacagtgatctttaagcacggacctgtagtggtcaagaaagtaacacaggcatttccagtattaatgccagatattttggtttatactccttgaaagactgcctgaatttcaggctgtgtagaactgactcatcctggaatctaggcctacatattgcatatcaggaggtgcaatatgaaaataaagtcaaagcaagggcccagg

SEQ ID NO: 389234 - DNA, 354 bp, Homo sapiens
ctacagttctggtattcatatttgtttcagtcagctaatgttggactctgttagcacagctgtttggaatttaaacttttcaagaattctttcatccttattattcattcctgttttattcttggatatcctaagtgcatacccagactaatgataatatcaacacttgttcagtatggttggtcatttttaaaaataaacaggcaatttatgggtgacccacacaaagaacagctgctgccatcactcacgccctctccattgttgatggcctctgcaactgacattgtcccaagcagctgctgacagagctgccagtacctgtttccacgtccaacctttattctattcgtt

SEQ ID NO: 389235 - DNA, 482 bp, Homo sapiens
agtttaagaaaacttgtatctactaccatggcttgacagcttcccaatattaacatcttctgatgagatcagtggtaattttaatgtgatgttttacattttgggttaaacgtatcaacatttgaaatatctacataactcggtgaaacaatttctctgatatatatataacaaagtcatgtatgggtaaaagatccattcaaattgtaatatatactaatggcttttaagtaacatggtccaacaagtcctctgaaatggtttcagatcggaaataacatttaagaaatttccacatgtcaagtttgggagtataaaggaaaatatccacaactttctgaaaaacattacaaaaaaatcctcattttccaactacaaatttgtataaggccagataattttcatatagtttgaccaaaataaatattgcaaaagactaaatgcataaatggatataagtatccatctgtcttctattaggc

SEQ ID NO: 389236 - DNA, 981 bp, Homo sapiens
gcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgtcggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggtgttttccagaggcatcactgtgaacgcggtgcgggggttccccatgagtgcggccatgttccttgggtacgagctgtcgctgcaggctatccgcggggaccacgcagtgacgagcccataagcgccagg

SEQ ID NO: 389237 - DNA, 723 bp, Homo sapiens
gcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgtcggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggtgttttccagaggcatcactgtgaacgcggtgcgggggttccccatgagtgcggccatgttccttgggtacgagctgtcgctgcaggctatccgcggggaccacgcagtgacgagcccataagcgccagg

SEQ ID NO: 389238 - DNA, 1201 bp, Homo sapiens
gcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgtcggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggaggtgaacacaggatgactacagtgttccctgggcctcatctctgcatgtgaagccctgagagctgcagatgtttggcctttggacctccaagtggacatcaattagcaagcgtgggctaggatggtgcagacactgacgtggcccttctgatgcctgggatgcctcatgagtcactgattcaagccctccaaggttctgatccccaatgcccactctgctaggctggcatcaaagagctttcccaagaaaatgtttggtcccagctgagaaagtcctgaccatgagcaccagggagccagaaaccacccagagaaacgttgcttcactcctctgtctgaggatggggaggggccagtgagctctgggctcagccactccctccagtctcaagtaacacgtccccgtgcctccagtctcctctcagcaccgaccaggtttttccccgctcctgcacccgtggatcctgaggacagcggtagcgccttcctcaccgcacgctgagtccagtgcgtgctcctcactgtgcacttattagtgtctgttgagtgattaaatcacatcctcaggtctgcagcaaataaatgaaagtttctttattttttatta

SEQ ID NO: 389239 - DNA, 721 bp, Homo sapiens
actgccaagacatcagtgaaaagtctgtatgaagtggatccaaattattagcctgcctaccactccttgtgcgtctcatcaattgaacccatccctagaccaagggccctttaggtgaagaaccagcccagaagggaaagagaaaagagtagaaccaatggacctccagatgggagcggcggtcagtgagtagtttagagccaggtacatgttagcaccctggatacgtgcacatgccctgatctttgcttcccatctgtgaacttcaacacccacgtggctttttcttatatcctttaaatacatatctgacttagtatcacctcataaaagataaagaatcatagtgaagcagaaacaagccacagaccagtgtacactcaaactgaaatcctctttttcccaccctctccctcaagaaaacatccctgccgacttgagcagtatgatggccatagcgaagcagagtggcccccagggatcccactctgtcctcgcacacgcgcacacacgaagagcaaatgaagcggatccaaggagtgatgacaagcgctgcacaggaatgtttgccaaaactcttctgggggatccgagtgctctaccaaggacatgagtatgccctgaatttctgcagctaaggccatatagtctggtgaccaagcatttggttcctagcttcagtctttggttcaaatccctgcttggcaacttactaccacac

SEQ ID NO: 389240 - DNA, 436 bp, Homo sapiens
ctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtacccttcattagtgtagatagtcattccctggtagggtggagggtaagagatagggtctggaactgtttgggacttttggggatgtcctgtgcctcccagattcctcgattctgggaggagaggctgccgcattc

SEQ ID NO: 389241 - DNA, 657 bp, Homo sapiens
ggagggctttgggcccaggccctggccagccctgcctcagaggttccagggactggctgtccactggatgggtgtgcaaggctccagctagtgtcaggccagagaattttgcagggacaggaaggctgtgaaggtgcaggtggcgtgggcggagtcagacctaaccttgagtgacacctgctagttggtgccactcaacttccgaggctcagcaccctcatgtgggaaatgggactcccacactggcctcaccgggtaactcaggggactcaggaagtactgcatgtgagagcagtcccaggcccccgatagtggcaatttatgattgtggcttcacttttaggctagggcctttttgcagcctgatgtgaggcccaggaagagataaaggggaaaagacaggccagagcctcatcggatggcagagctggggcaggaagagctcagggagccttggggccatcccccttgttttacagacaaggaccctggataaaatgtttaccaagaatcacacaaattgtaagtggtagggccaggacacagacagggagtgtggttccaaaggcctatgctttccagtcaactatgctgcgtgcacagcctcccacccaccgccaacccagctgccctctgctcactcgctcaacagatgtt

SEQ ID NO: 389242 - DNA, 215 bp, Homo sapiens
tctcctgtttttcttaggatttttttataaggggacagccacataatgtgtttttaatatttgttgtaaatatttattaagaatcctgtttacttgcctccataactctaagttgttcctctttaatttttccttattttagttgctaaggcaactgttttgactactgtgacagttttcctgcccaagaaagttactttgagtgaccacccact

SEQ ID NO: 389243 - DNA, 515 bp, Homo sapiens
ttccacagtgcctatgtgccacattttcttaatccagtctatcattgacggacatttggattggttccaagtctttgctattgtgaatagtgctgcaataaacatacgtgtgcatgtgtctttatagcagcatgatttataatcctttgggtatatacccagtaatgggatggctggatcaaatggtatttctagttctagatccttgaagaatcaccatgctgtcttccacaatggttaaactaatttacagtcccaccaacagtgtaaaagtgttcctatttcaccacatcctctctagtacctgttgtttcctgactttttgatgatcgccattctaactggtgtgagatggtacctcattgtggttttgatttgcatttctctgatggccagtgatgatgagcattttttcatgtgtctgttggctgcgtaaatgtagaagatacacattttttaaataaagttcactatggcattttccatattcttattagaaaataaaaatggtgctg

SEQ ID NO: 389244 - DNA, 380 bp, Homo sapiens
catgaagcagagcattgtatgttcctcatggggtcttaggtagcttagaggggctggagttatatagcaacctgcattttagttcactttgtggctacatgaatttagatctaagaaatgaacagaaactattttggtaatgctttagaccaacagcaaggaattattttacgtttagaacaataaaaattagaaaaagagtaaagtagcaattgagggattaggaaaattgctccagcaaataatagcttaatacagctccccaatattagaattacatcaagtatttatatttttgaaagcatgatgaaagtttttccccgctggccacatgtatttatgctttttaatttgaaagccaagacttgcttttcttaaaa

SEQ ID NO: 389245 - DNA, 740 bp, Homo sapiens
aaagtagtagtccaaaatgtctggaggatataagcagaagttggagatgaccctagaaagataagctggtacccaaaccatgaaaagccttatatgccattacactagatggcagcagggcccatgtctatcttgttcatcattgtacctctagtgcctagtataatgcctgacacataaccagtactcatttaatgaatatttagtatactatatatagcaggcagtgggaaggcaactgacatttttaagaagtggaaagacatgatgggaaccatgttttaaaaagataggtggggcagtatgaagaatggatgaggcgagacaagaagactttaaggaccagtaagagggctattgcactatcaaggaaaaacgggagatcccaacctaagaagctgcagaagaagtcaacagagggaatgatgaacacattacggagaaaaaatcaaacgtctctggttaccattgaaatggggggttgagtaggagtacggatgggaggagaggtaagggagaagtcacagaagagtacaaggtttccagcttctacaaccaggtaaaaggtgactctactcactgaaattagaaagcagacaaatggcagataaagcaggatgaggaacttggctttgcccaagttgattctgagtgacaaacatcagagaacaatgtctcaccgtctctttcagctgcactaccttctgccttaccacttccaatcaatgtacttgagagat

SEQ ID NO: 389246 - DNA, 707 bp, Homo sapiens
atagcatgatggcttttgttttacctgtttgtgtggacctgtaaaacgttttaagatgagagctataaaaggaaaagcaggatggtggtgccacatcacaaagcaattttaatctgctagataccttgagaggaaaccatagtccaagataaaggtaaaatcactagaaaaattgttttcctgatttttgtgtttttgctcttataccttttggttgaatctctccaataagatggaaaaacacttaatagtgctaaataccatattttcttcatctctccaaggtaaacttcagatagaatttcttttttttccctacacaaaactgtccttcatactacctcctttccctgatgttctaatctatacataggccacgttctactctctgatgtagacaagcaagagacttggcaccttgaaatttgaatagaaacccaaagagcccatgttgttgagctgctatttatgtcctgttcatttacatggtagttttgtgatattccttgttgctttcacagaaaggtttctcaggctatttcataccaacatgaacttatctggggggtttgccacgcttactggctcttgactccctctttttttaaaacttttattttaggtttagaagtacatgtgtaggattgttagatagataagctgcatgtcacaggggtttgcaacatgcacattatttggttacccag

SEQ ID NO: 389247 - DNA, 447 bp, Homo sapiens
gctgggattacaggcgtgagccactgcgcctggcacactcttgctttaaactcgaagagacaaattcataaaagctcaggagctgtcccagtgttaggtagctgttttgttgccacgctggagcacagttttgccatgctggagcacagtttagttagaaccattccagatacttgaaaactaggtgttgccgagaaataatctactttgctaattacagactagtttttttcagtcatcaggacaaaaggttctgggtcttgaaaaagccgttttgctagttgagtattactttggagtagagaggcgtccctcactgcagctgctgcacctggagcagtgtccaaccagtcacacccagagcccctggtccaagccgatattctgtgcatctgccttctgcagcaaccttgagattgtggtggatgcccccctagtggcttcttc

SEQ ID NO: 389248 - DNA, 261 bp, Homo sapiens
cagaaaaagcgaaaacaataaccagaggttagtaagaggtagaataaaccaggataacattacagaaatgaaaacgcaatctgcataaccatcactcagacagacaattgaaatgctctacaggttcaccagagacagcaaagatggggttggggagtagggcagagggggacgcgcagaccagggacagagccggcctcctcagagccaagtcagcagagcagggcaggggcgcatcagacttgacaaagcacaggcaac

SEQ ID NO: 389249 - DNA, 117 bp, Homo sapiens
  misc_feature (6)..(6): n is a, c, g, or t
accacngagcaggtccgtgccttggagggcgtcttccggcaccaccagtacctgggccctctggagcggaattggctggccagggagatgcagctctcagaggtccagataaaaacc

SEQ ID NO: 389250 - DNA, 394 bp, Homo sapiens
taagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaata

SEQ ID NO: 389251 - DNA, 715 bp, Homo sapiens
cagtcttttagtttttttacccatacccaatttaaccactttttgactggggatgggttgaggggagcaactagctttttttttaaagtatttctaatgcattcaacctagctttcaaataaaaccagaagtcttttacactcacagtttatggactgctgaatatttaactaaattacataattaccctaagtaaaacaaacaggttcaatgaccactgccactagccttttgtaagcatgcagctgatcatctgttgggacaaaagcataaggttggttagagaatagcctcctagccagtcttctaccatgtgataagtaagtatgcctatcggctagttttactaggtaaaaattggttaagaggtattgtatgtgcgaaacaccatgtaaattactctacttgcattatctcttttaatcttcacaacaaccctaatacataattatgttaatgtttgtgttttgcctttgagaaaacaaacataaagataagtgttttacataaagttacatagctaataaaaggaccaggatgggaacctcaggcattctaatatgtgctttaccatttcatcacaagtccaaggccataaaggttaatttgctacagagcactaagctccagtttggtccatgatcacaaactgtaccttggaatcttgacctgtcatcttcaaactaagtgctacggcaataaaatatgggatatt

SEQ ID NO: 389252 - DNA, 404 bp, Homo sapiens
gtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactattatatactatgcctgaggtgacataatattacttgaagatagattgtgaaaagttaaagatgtacactataaacctaaagcaaccaataa

SEQ ID NO: 389253 - DNA, 641 bp, Homo sapiens
atggatttctttaatggaattctgctctagcaacttttatttgctaactcgaaactgctgggatattattcataaatttttttaaaagtcactttggaatccatcatctcaatgataatttctttgtatactttattagaggttacttttttttttttttgagattgagtcttgctcttttgccaggctggagtgtagtggcgcgatctcggctcactgcagcctctacctcccaggttcaagcgattcccctggctcagcctcccgagtagctgggactataggcgcctgccaccatgcccggctaattttttgtattttagtagagatggggtttccccattttggccaggatgatctcaatctcctgaccttgatcccctcacctctaattaaaagaatttggaatatggttgtttagaatatgcttattatgttttccaaatagcttgtttactttttttactttgatttaggtatgtaaagattggtctcagtgaaatataaactttacatgagagtataatatcctactatctgtagataaataagtaatttttttgagaattatttaacatgaatgtttttaaaaagaaaatagaaatttaatttattaagattaaatgttttcttattataat

SEQ ID NO: 389254 - DNA, 498 bp, Homo sapiens
cccagtttttaccctgtttataatttgcaaggagaagctaccagaacagaatgctttctggaatctgttgtcaaggagagagtaaattaagaggaattggacctcttcacataggagcgaaaagagcccaggggatatggaaaagcaggaagatgaaacaataggcatttctcagtgaccctgtggcctgtcctcttcagtccttgctggccccagatgtgataggtagcaaagacatgcaccctttgcatctgcccagctcagcctcacattctcccttatcaagattgaatgtgttctcagaatctcaggcctcactatttggaggaaccagaaatttttctgcagtggcccccaaatggctggccactgcggaaaacttctagcctcccttcctgaacagattgttgctatccatcattcatatagctggtcttctgtctcagttccctgtttatgctcctgtcctcaccagggtggagcaccaccctgaaccag

SEQ ID NO: 389255 - DNA, 614 bp, Homo sapiens
aggagaggagagaggctggggagtcagcccagtgttggggctcacacaagggggagtccaggggagtcaggagcaccacaaacaaggctccagaaggacagacggtgggagcactgccagcctgggtggggagataaaggggtggcaggggaggtggccaggaaagaatctacatggcaaggacttcccggccccaggcctgggctatgcctccatggtgatcgtcttctactgcaacacctactacatcatggtgctggcctggggcttctattacctggtcaagtcctttaccaccacgctgccctgggccacatgtggccacacctggaacactcccgactgtgtggagatcttccgccatgaagactgtgccagtgccagcctggccaacctcacttgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctgaaagggggtcaaatccatgggaaaggtaccactagaggcatgcaggggggagggtggct

SEQ ID NO: 389256 - DNA, 827 bp, Homo sapiens
gataagaattaaccaaccaagtatatgctgtcttcaagagactcacttaatacataaggactcacataaacttaaggtaaagtggtggaaaagatatttcatgcgaatggacaccaaaagcaggcaggagtcgctattcttatatcagataaaacaaactttaaggcaaaagcagtttaaaaagacaaagaggaatattatataatgataaaagaactcatccaacaggaaaatatcacaattctaaatacagatgtacctaacactggagctcacaaatttataaaaaaattactactagacctaagaaatgagatagacagcaacacaataatagtggggaacttcaatactccactgacagcactagacaggtcatcaagagagaaaaagtcaacaagaaaacaatggacttaaattacaccctacaacaaatggacttaacagatataaacagaacattctacccaacgactgcagaatatgcgttctattcaacagcacatgaaacattttccaagatagaccatgttataggctacaaaacaagtctcaacaaatttaagaaaatcgaaattatagcaagtactctcagacctcagtggaataaaattggaaatcaactccaaaaggcaccctcaaaaccaagcaaatacatggaaattaaataacctgctcctgaatgatcactgggtcaacaatgaaatcaagatgaaaattaaaaaattctttgagctgaatgataatagtgacacaacttatcaaaacctctgggatacagcaaggcagtgctaagaggaaagttcatagcatatttcatgcctaca

SEQ ID NO: 389257 - DNA, 156 bp, Homo sapiens
ggttactgtgagaactgacggagacacagcttgagaagaactgagcgtgctttccaggcgacagcggacgctgaggacggctagctcttgtgtagatgaaggcacccagcagctgctcaacctgcaacggctcagttctgagaaccatggacacag

SEQ ID NO: 389258 - DNA, 705 bp, Homo sapiens
tgctacagaatacacattcttctcacctgtacatgaacacttctccaggacagatcatatgttagcccacaaaacaagtcttaacaaatttaagaagactgaaactgtatcaaatatcttttctgaccacaatgatatataactagaaataaataacaggaggaactttggaaactttacaaagatgtggaaatcaagcaatatgctcctgaataatgggtcaatgaagaaattaaaaagaaaattttaaacatttattgagacaaacaaaaatggaaacgcaatatgtttttgctatggaatataccaaaaacaattctaagagggaagttgataacaataaacactacactgaaaaagaagaaagccctcaaataaacaacctaatattgcatcttagggaactagaaaaacaagaacaaactcaactaaatattagtaggaggaaggaaataataaagatcaagcagatagagagtagaaaaagcacaaagagacaataatttactttcataagtttgttaaaatttaaatctgataataccaagtgttggcagcagtgcagaggaagaaactcatatattcttggagagaagataaattattctatcaactctggaaatcaatttggcaacgtctaccaaatgtgaagaggaatgtactctatgggctagcaagtccagttccaggtatatgctgaaaata

SEQ ID NO: 389259 - DNA, 461 bp, Homo sapiens
ttggcactagagtatttccttgaagaacagtagaatgggtggggggttgaactgcaggagcacttccaacagctgtatctcctgggatcagtataccctctagcttctcactggaaacagtttggctgcacatttctagcagcttcttgtgtttgtgtcttctatcatgcctgcacctaggagcccgtgtagcaaatgaagcataaacctcctcaagtgttaatgggagggatggcactccctacatcttccctggattgctctagtgattaatccaggtctatagtttcccttgaaagagatttgaggcctcagtgagcaaaaatggaagggtcaaaacccaccatgccttttcccagctttctccagatatgtataaccttgtaatctctccctggaaggagactgggagacagacctctcttatgctatatgtgaggaactgtacttcacctgccttc

SEQ ID NO: 389260 - DNA, 277 bp, Homo sapiens
tgagatagagagttgcacgtcacccaggctggactgcagtggcacgatcatggttcactgcaacatggaggtcctgggctcaagcaattctctaacttcagcctcttgagtagctgggactacaggcatgtatcaccatgcccagctatttttttaaatgtaatttttagtagaaacaggatcttgctatgttacacagactaaaatttcagtaagtatgtgtatcccctgggggggtgctgtaatatttaaatgagtatgtgaatgcacatacata

SEQ ID NO: 389261 - DNA, 909 bp, Homo sapiens
ggctgcgagcgcccaactgctccgactgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccaggcaccatgcagcatattgattaccagcttgagacttgcccggagccaaggtataccggtacacagcatccttgagaaggcaggcaaagaacccatcatgagggctgaacttcagccatatatgttaaaagaagcgctatataatatacgaca

SEQ ID NO: 389262 - DNA, 1032 bp, Homo sapiens
ggctgcgagcgcccaactgctccgactgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagcttaagaaattacttgttttcctgaagtagaattgccatatccaatccagtttttctctagttcttacgtaagaagaattctaaaaattaaatatatagaacattgttatttggcaattttagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccaggcaccatgcagcatattgattaccagcttgagacttgcccggagccaaggtataccggtacacagcatccttgagaaggcaggcaaagaacccatcatgagggctgaacttcagccatatatgttaaaagaagcgctatataatatacgaca

SEQ ID NO: 389263 - DNA, 895 bp, Homo sapiens
ggctgcgagcgcccaactgctccgactgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaa

SEQ ID NO: 389264 - DNA, 851 bp, Homo sapiens
tgaacctggcttaatgtttttacaatagttcagagtacattaatgaggtacccgctatggatttgctggtggtcataatgagaaaggcagaaaaactgtgtaggcagtagtttattctagtaataaactgtgattaaatgataacttgtataggattcttaattgcttcataaccatcattctttcttaggtctcttcctactcactagaaagcaggtgcagcaaaagggagaaaatgaacatctttctcaagctgaaagagttaaagaccaagacagtactcctgcctgctgtgttcagacaggtggactagttaaattgagcacagaaagctggatagctgccctgcttttgatttgtacaggtggctgctgtggccacagggacaaagacaactccttggttggggttgagagtagaggcattgaaaaattgctgtatatttctgtaggtctttttgttacctttgcttttgaccttgtagttttgggacacccagagacacagcctgcctatagactgtaggactataatttccttgggatttaaaaacaaatccagctcagaagcaccacacagacattctttaaaagtttgtttgaggccaggcgcagtggctcacacctgtaatcccagcactttgggaggccaaggtgggcggatcacctgaggttgggagttcgagaccagcctgaccaacatggagaaaccccgtctctactaaaaatacaaaattggccgggcatggtggcacatgcctgtagtccagctacttgggaggcacaggttgcagtgagctgagattgtgccactgcactccagcctgggtaacgaagtaagactctgtctca

SEQ ID NO: 389265 - DNA, 719 bp, Homo sapiens
tcataaagtgatgaaagaaccacgttcctccccttcaagattcagagacttgctctatcacccaggctttgcagtggcacaatctctcctcaccacaacctcctcctcctgggttcaagctattccagtgcctcagctttccaaatagctgggattacagatgtgcaccatcacacctggctgtgtcaagagttatggtacaactgtctacccagaaatcggagtttctccttgacttctgtgtcaccccacacaacaaataagtttccaaagcccatcagttctggagaatatatatttccctttcctcttttcatgtctaccaccatctttgtatttttagtacagatgggtttttgccatgttggccaggttggtctcgaactcctggcctcaagtgatctgcccgccacagcctcctaaagtgctgggattacaggtggcatgagccactgcgcccggcctaaactcatctttacattaacaagcagctgttacctaaaacaactaatgaaatgtgaactctccccgctatcctctgcttcagtggctccctttcacggttcatggttgtcaccaggtgctctgtgcctggggatgtatatgtccagtttacccatctgaaatgcccttaaccccacacctaacactgtttttggactgttaatcccaaaaatgcaggactggctatcttgctccctaatgtctacatccacatg

SEQ ID NO: 389266 - DNA, 104 bp, Homo sapiens
ttgctggaaggattagggttctgaaaccacttttgcaaaacttatgacagtgagagaaatctaacatagcagactccatcttgcttctaacctcacaagcttat

SEQ ID NO: 389267 - DNA, 731 bp, Homo sapiens
ctttcttgcaaaaggccctggagggacaggaagcagctgtcagaccattttctattccagaccatgccagctgagccagacttaaggcaacaggtggtggtagaaggccagagaactagggggaaaggcctggtgcaaaggcaagatgacaggtgagaatggggcaggagcacaaggccccaggggtctcaccatagctctgcactgtatctccagcccttgttctttacactcataccctcccaaacgaggcctcatgagccacctgtaggctcagaatggcaatgaagggaggccacctccctcccacctgcaggtgggcagtatccttgcaaaccttctaccaggctggtcctgggctgggctctgctgccagcagctccagttggtacttgggttacattgtccctgctccaacgcatccttctagttaaatgataactgtaggccataatactcttgagtacatggttgacatttggccattttataggtccagcagatggctgtggattggccattggctctagttagaatgccagtcatttatccaggaaaatgtattttgtaggcccagacttccaatccataacttcttacttcaaacctgatccatgtgcagattgcaaacaacttgtcctgtcttggaatgttctattgtgattaaataaagcttgtttgggtgccccagctaaatgttagcatcttggggaagagacgaaaaaaaaaat

SEQ ID NO: 389268 - DNA, 386 bp, Homo sapiens
ccaaattcttgatgactcttttctgttccacaaattttaaatgcagtgctctgtagctttctactgaaggcctccccaaagctttacaaaatcagtcatcagtacatcagcactctcctctgttcttcagtgaaatacaaatctgcctaatggattgcttacggttctctgacagttctgatttgctaagaacatgatgtgtggaacctatggcatttctctgacctgtcagcctactgacctcattgtgtgggaaagggaagcagagttagctttgtgtaactggttctccctgaacccatgatggtttccagtgattacttccttttcagtaaacggatctgagccattttgacttaggacaagttaaagaagggcttggtgtt

SEQ ID NO: 389269 - DNA, 567 bp, Homo sapiens
cgggcatttgggatgaatttgtgacaatcagaattaaaatgcagctatcttacttgtaaaagaggtccctggtagctccaacagaggaagataatccaagcttttgctttgtcaagtgcgtaaaatacctttgttgaagtagagaaggcagcacatttaaaatggaattaatgacactgaattaaggaatttgtatggtagtatgtgacattatgttgtacaaatgaatttccttaaggcttcactttctgaaagttttgtttttactttattcattcattcattcagcaaaaaaatattgaatgctgagtgcgtgttttaggtcttgttagacccaggaaatacttgtgaggaaaatagaaagggttcctgccctcaacaagcctcagttagcagatgaggaagaccaacaaataagcaactacaatgaggtatttggtgttaattggtcatatgtatattggacgaataattcttcctctacagtctaaactaatgcttctcaaaccttaatgtgcttatagatcacctggggatcttgaaatacaaattctgattcaggaggcc

SEQ ID NO: 389270 - DNA, 869 bp, Homo sapiens
acaccatgtaagacgtatcttgcttcccctttgccttctgccatgattgtaagtttcctgaggcctctccagccacgcagaactgtcttgctctgccacccaggctggagtgcagtgacatgatcacggctcactgcagcctcaacctcccaggctcaagagatcctcccacctcagcctcccaagtagctgggactacaggcatgaaccatcatgtccggctaagttttgcattttttgtagacacagggttttgccacattgcccaggatggtctcgaactcctgggctcaagcaattcacccctgtaggcttcccaaagtgctgggatcacaagcatgaaccaccatgcctggctcattctatctttcttgaaaaaacatcccaaagaagaagttcaaactactcggataaattaatattagatctggtaaaagtaggtattaaaaatctctcaagaactctcatcagactgaacaagcaatttcagtgagcctacagaaatgtggaagggttatggttatggctctgtttacaaagaatctggacaaaagttgaaagcacgcaatttcagtatgaatttacatccttcgttagaagaataaccccttatatgaacacaaggaatttctcctcttgtcaaggattatcaccaatttttaaaatgtgattataactatgctaacaaacatatctacattttcttaccaaaagactggaatgaattctcctcccctctccaccaccaaatctatcttggtctttttgaatggtggaaatatgggtgattgttttcctttcagcttgtccacccttgccaaactttccttaatgattacaaaattccttttgaaacttaaaaaataaaa

SEQ ID NO: 389271 - DNA, 633 bp, Homo sapiens
gaacatgtgcaggggaactcccatttataaaagcataagatcttgtgagacttgctcaccactacgtgaacagttttggggaaactgctcccatgattcaattatctccactcagccctgcccttgacaagtaaggattactataattcaaggtgagatttaggtagagacacagccaaaccatatcagagactatagaggtaaacatacacatagggtcaattgattttggaaaagtgtgccaaagtaattcaatagggatcagatagacttcaacactgttgctggagtaattgtatacctttatgcaaaaaaacaaaacaataccagaacctcattacctagtgagtaccatacaaaattaacttagaagggattatagaatcaactgtaaaggctgaaactataaaatctttagaataaaactttgtgtgtcttttcacaaaggtgaaaaatctttgtgaccttgagttggtaaatggtccttggatataataataaataaaaaaattaattggtttcatcaaaataaaagtattttggcattcaaaatctatcatcaggaaaaagaaaaggcaagcctcagctaagggaacaatagtttctgatgatgtatctgataaagatgttaaa

SEQ ID NO: 389272 - DNA, 209 bp, Homo sapiens
ctggggaagagaggcaagccgacgtctagcaaatcctgcctcaggatgaaagtgtaggggaggtggcagcactcccggggaccgcccagccccgggctatgcagaagctaggcaggcctaatggccagtccaggcaggccctggcttgccctgctccaaagtatggagatagagtcccggtaagcaccaaatacttttttttttttttt

SEQ ID NO: 389273 - DNA, 552 bp, Homo sapiens
ggccctcactgctgaattgcttacagtttctgagctgtaaactaacatttgctttactatgtagttacagagaaatgtgcaacttgtttgtgaaacattcaaataaagcttatctgggatttttaacttgtgtgtttagtcttagaccatctttagtacagtctggtctaaacactgtgacagagcaaagggacctttttttccaatggtgcacagtgtcatgggtgcaactggctggtgccggtgttgtggatggtaaaagaatttaccggcagggcgtggtggctcacgcctgtaatcccagcactttgggaggccaaggcgggcagatcaccggaggtcaggagttcgtgaccagcctagccaaagtggtgaaaccccatctctaccaaaaatacaaaaattagctgggcacagtggcgcatgcctgtaatcccagctactcaggaagctaaggcgggagaatcgcttgaacctgggaggcggaggttgcagtgagccgagatagcgccgctgcactccagcctgggtaacagagtgagactctgtctc

SEQ ID NO: 389274 - DNA, 335 bp, Homo sapiens
cctgaagtgatccacctgctttggcctcccaaagtgctgggattacaggtgtgagccactgtccccggctttacttttggttttcatatctttctattcccttgcactataacgttgtattcgccaaggaatttcagaaatgaaaatgaggttagactagatgactcttaagacccatacccattttggggtctgtgaagtgttttgacagaataaaaagctgccctacatgtcttgctaccaaggaggttaaaatgttaactagtggattggagaagtgagttttatgtgacttttaaaaaatatattattgaattgaaaacagaatgtttggt

SEQ ID NO: 389275 - DNA, 490 bp, Homo sapiens
gattgtccattcagaaggacaatcgtctgtactttatggaggcaagatataagtcaagtgagaaaggaaggtaggaccaaaagatacacatagttgatctgtgaagtctggcggttaccggggagtaatgagttacataatgaacaggaaccagaactaaatctatcattagggaattatatctttttccataaagtacagacgattgtccattcagaaggacttttaaaaattcaagtttatggctgatttttggctgtggttaattgaagttccaagaaaaagagtaatataggaaggctgaattatttggagggttcctatgccattatttatcatcttagaaataatcatagagctgggcatggtgactcatgcctgtcatcccaccactttgggaggtagaagcaggaagatcgcttgagccaaggagtttgagaccagtgtgggcaacaaattgagaccctgtctgtacaaaaaaaaataatat

SEQ ID NO: 389276 - DNA, 2961 bp, Homo sapiens
gtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactc

SEQ ID NO: 389277 - DNA, 312 bp, Homo sapiens
tgcaatttttttgtgaatctataatttcaaaataagaagtataaaaatgaaaaagagaaatcttctcttgagtctcccatactagactagctgctgctctctgcttccttcttctgcttttttaatagaaaacttctcaaaatttatctacttgttgcctttaatacctctcctatgctatcttgcatctgctccaatcatagctctgattctttcaccagctcccaggaaactgccctgtcaagatcaccaatgacatctatgttcctgtctaggggtcagctattcatctccattgcacatctgtcactc

SEQ ID NO: 389278 - DNA, 133 bp, Homo sapiens
aggcacagacacgccaagggataccagcagcgtctgagacctgaagcagaaatgccagggatgaggatttggaagattaacacaattgaactcagcactgtggccttttttttctttctggggcttcggaaag

SEQ ID NO: 389279 - DNA, 269 bp, Homo sapiens
atatcttagtaggatgccaaatagtaattatcctattatcacctttttattacttcttaagtttagttttaagttttactacttaaaattgttagcataggttccttaaaatcagtatgttactacatgcttctccgtttctgaaagaattcttcttaagaaaaaaaattagttgaaaaatgtaatatgtctgtattaactaatcagataagatatcaaattttgtgagggatattttactcctaagattctaatgcaccatgttaagc

SEQ ID NO: 389280 - DNA, 565 bp, Homo sapiens
taacagagcctcaataacttagtcacaatcgtacaggcagttaatggtagaactgccattagagcccacaatatctgttttaatcttgtttgggttttctttctattatatgggagttaacaaatagtttcccaaaaattccaggtgactttgttttatagtccaatttttttcaaagacacattgaatattatacatttttattaaatatttaataccttttagttaggaatattttgaaacttgtttcagaatggaaatttttttttttcaagccaaagtaagtgataatgcttagaaaagggaaaggtaactaattacaccagacagggaaataatttgctttgtaatagttccaggccatcagaaagtacatagagtgagtcaggttacttctcaaagaacatctgctgaattgattattttcatagtgctttaaaaattaaaattttgattctgttaaaatttttctcagaaagttttgaatttgatattggtaaaaatggtatttcaaagttgctttgtctcgctaaaattgtaaatttttaccaatttgtaaatggag

SEQ ID NO: 389281 - DNA, 295 bp, Homo sapiens
ttaaggcagcagtgagctttaattgttccactgaactatagcttggacaacagagcaagacccagtctctaaaaaaagaggaaaatcacacttccagattccctcctcaacagtgtagttaggaaaccacttctccccaagtataaaacgtgaggttggccgggctcagtggctcacgcctgtaatcccagcattttgggaggccaaggcaggcagatcacgaggtcaggagaccaacaccatcctggccaacatggtgaaaccccgtctctactaaaatacaaaaaattagcca

SEQ ID NO: 389282 - DNA, 216 bp, Homo sapiens
ccctattaaatcattaagcattgcatgcaatacttttgctgtgaaaattattaacttcctggtatataaaattatttctagttatgtttaaatattttctctgggatattatcatcttagatctgtaaagtggtactaaaatagttaaaaattatttataagatatacacaaacagaaaaatataaaatcaaatgtatcttatacatagtacttgg

SEQ ID NO: 389283 - DNA, 464 bp, Homo sapiens
caatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggttaaatttatggcatttactta

SEQ ID NO: 389284 - DNA, 645 bp, Homo sapiens
ggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaa

SEQ ID NO: 389285 - DNA, 330 bp, Homo sapiens
ttgttgactaatattccattatattgatataccacaatttgtttatccattcatcagctgaagggcatttgagttccatccagtttggggctattattaataaatccactatgaacatttgcatcaaagtctttgtgtggatctaggtttccacttctcatgagtaaagctgggtcatatagtaagtgtatatttcactttaaaataagctgctaaacattttctgaagtgtctataccattttgtatttttactagcaatgtatatgagttacagttcctctttatcaccaacacttgcggtctctgtaatttttgtcattttaatcag

SEQ ID NO: 389286 - DNA, 290 bp, Homo sapiens
aaatttgatgagtcacaaccttggagttggttaagatgaacacacattttgaattttattaatcaagccgcaatattcttctgttcaaaatagcatcttgtagttatcaaaatgtatgaattttctttatatagttcctacagaatatttgtgatgaagctgctgatgaatacaaatatgatatgatattgatgatgtattgatggcagtgcctgcttttcatctttgctgcccatgagcaattgaaatgtagttgtgtgtgctcttttggagaacgattttaaatcagc

SEQ ID NO: 389287 - DNA, 130 bp, Homo sapiens
acccagggtggagttggggactggaaggttgatccacttctaggccacctcaggttgtttgcagaattcatctcattgtgggccgggcgcggtggctcacgcctgtaatcccagcactctgggagaccga

SEQ ID NO: 389288 - DNA, 618 bp, Homo sapiens
cgggccctgcgcggggaggctggtcccaatccttgcgtgggcttcgtcgtgggcccggctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccaggtgagctgtgaggggtgtggcttggttccgtgatgagccaggtgcactatcccgagaccatggagctatgaggggtgtgcttggttctgtgatgagccaggtgcactatcccgagaccatggagctgtgaggggtgtgcttggttctgtgatgagccaggtgcactatcccgagaccatggagctgtgggagttgtgcttggttctgtgatgagccaggtgcactatcctgagaccgtggagctgtggggggtgtgcttggttccgtgatgagccaggtgcgctatcc

SEQ ID NO: 389289 - DNA, 123 bp, Homo sapiens
gaagcaggtgacttataaagtaaaggaaggaactttgccagagtcttagaagagttactgtgctagcctgagcccttagtagctcctggcttccagcctgtgcatacacctgtgactggacaa

SEQ ID NO: 389290 - DNA, 411 bp, Homo sapiens
agggatttttcattagggagtgggatgtgttgatgtgataaagcttcttgaagtagaattttatggcaagcgtgatattgtaacttgcccatatttatgcagcttttaagtagtaaagctacgatttgaactgggtctgtttgtcttgaatgcagaggccccagggaatttaccaggtctggctctcattggttttggatagcagaaggttgaaccttaacatgtcagtcattttatttgctagattgattacattttgtctggaacatggtaatctcagactctagtcagtcttcagcttaggaaatattttcttgattattatttctattccactacttaagatttgttcttaaggataaaaattacttgtaaagataaatctccagtatttactatttttattatctt

SEQ ID NO: 389291 - DNA, 241 bp, Homo sapiens
ataattttaaagttggaagtcaatataacatgaaaggcaaatcatgccataaacccataggcatggcaaaactcctaagagctactatgacatttttcaacataaccagaggtataattgaagaagtgggtataatattcctcatcaccctttttgcagcagcctgttgtcaaaagtaatcatattttagtaggcatatttttctgaaatacgtttgtaataaatgcatacttatttttac

SEQ ID NO: 389292 - DNA, 632 bp, Homo sapiens
acagagcgagactccatctcagaaagaaaaaaagaaagaaagaaagaaagaaaaatgaggaagctactgatagtccagtatggtatactgtgatagattgaaaaaaaaagtggttatattttgcagcttctctcatcaagagagtctatttctcctctctttgaatcttgaattggccatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaatcagcttggactagaagaatttccaagccaactcacagaatcactaaaaataataaattattgttattctttttttattttttaagagacgagatctcagtctgggtgacagagcgagactccatctcagaaagaaaaaaagaaagaaagaaagaaagaaaaatgaggaagctactgatagtccagtatggtatactgtgatagattga

SEQ ID NO: 389293 - DNA, 325 bp, Homo sapiens
ccctttaattaactcagacctggatgacataaaatgaagtttctgaagaagttcaggtcaaaggttcctgaaacacaaggctcagtgtgtaccctggatgggaaaatgaactggtgttgacatatatgcatgcccaggaggaagactgggaacgacttaatgagttggggtatgcggagaaacaatgaaatattgaaaactgtctatataaaaatcactgttgggcatatgcattaaaaaacaatatgttattgcaaatttaacactaaaattattttcccaaacagaagatattgtctaaggaagaataaaatgctgaacccct

SEQ ID NO: 389294 - DNA, 130 bp, Homo sapiens
gcatcagaggcgctcggagcaggctgcgaagatgtggagggttggaccctactcccagcgtttcagactcagtagatctcaagttatgattttctctggcgcaggggctctttggcacacagaagatggg

SEQ ID NO: 389295 - DNA, 2247 bp, Homo sapiens
  misc_feature (228)..(228): n is a, c, g, or t
  misc_feature (1090)..(1090): n is a, c, g, or t
  misc_feature (1395)..(1395): n is a, c, g, or t
  misc_feature (1539)..(1539): n is a, c, g, or t
  misc_feature (1874)..(1874): n is a, c, g, or t
aacccgcccgcttctcctgcctaggctcttctttctgctcctgtcgccatggccccggcctcggcgctcaagcgaccctctcgctccgcccagacccctggatgcccagctgccgcacctcccgtggccccacgctgtggctacgtgttgtctgaagacgcctggggaaaccttcagggcctctgtactggcctgtcatgtggtcaaccagatctccttgattgcacngtcaaccccgctcctgtctgtcaggctcaggaaccacttacaagctatggcaggtgatgttccagcatcccacagggaggattatgctggtgagccacatggccaagcaggactatggcttcaacagctctggggcctgcatgttcctgcattagccctactccagcaatgaggctgaagttaccagagtgacatcatggtatctggtgcaagctatagcatccacctattcttggagcacacgtggtcagacactgattggcatgtgaccaagttgatggtggtcaaaacagaactcctttcatgcccacaagcttcagtattactatgttccctgccacttccgttgaagttttgcaggattgggatgatcctttggtgtgaacgaagccccaaagaggaccacgtggagagtgcctgactgttcctgtgatgtcttctagtacatgaacaggaatgaaacccactatgtcctccatgtgaactacatgctgagcgtgggtccagatgggaaaccattctcctaccctgcagaaatggtatatagtttcaaggatgtgggtaagtacaccaagtgaggtgctggtcctggactcatggatggtcttggtacccaacaagttacactggctctgtccaaacaacagctgtggaagcccctcccatgggaggggggtcccactggggctacacagaagtaactcctcacaagtggcttgtctgcatcctgggattggaaacccagtatagaagcagctgttggcagactcatgaagtaatacagagaatgggtggctgctcatacaatcagcagtaagacttcacttaaatcatgccaggaatgacatgaacaggactcaangtaccccatacagtcttccctcccaggtgccaccacccctgaaatattaaccttggtagacttctcctgtcaaggtcacagtaagggtagccagtggtatcaagaccttggtataaatcagacatggccttcttcccagcaaggtcattaggtacccaatgtagagatagcagggaaaggatataaaaacaggaaagttccaggtgagtcatcttttgccccttgactaggcctgcctataggtttgacagctccaggaagtaagaaaacaggtatattgtcttccttcctatagctctgctagntgtcatcctcttaaggtcactaggattctagtgttgaaggcttgctgccacacagatggcactgttctatcctcaaagcattttcagggtgccatctaatgggtctgaatcctggttccattgcaaactttaagcaaggaactnagcattatccaatccccattttctccaactactggccccctctaaggaggctgaagagtgaaagcatgttgaacaccaagatgctctccaaagatggagtccttctcttctgagccccacagctctgcaagatgggtaaaactcaaggtggcattaggctctgagaggagctccatcacacagctggcatagtatggagctggaccagagcccaaatcccctatctccccactgtcctaaccaaaagcttacacttcagaacccaaggccgtgaacacagacctcacacagctgtaacctgagaaactgccattgctgatctagtgccagaaccncttccccatccctggctttcctgctgacttcccacgagataagacttttctttaaaaagggggccttctcagccacacgcagtggatcacactgtaatctcagcactttgggaggccgaggcgggtggatcacttgaggccaggagttcgagatcagcctggccaacatggtgaaaccccatctctactaaaaataccaaaaaaaaaaaaaaaaaaaaaaaaaaagcagggcatggtggcatgtacctgtaatcacagctacccaggaggcacaagaattgcttgaacccaagatgcagaggttgcagtgagcctgtttgtacccctgcactccagcctgggtgacacagtgaaaccctgtctcaaaaaaaaa

SEQ ID NO: 389296 - DNA, 435 bp, Homo sapiens
ccagatgaacatttgagctgggcacgggatgatgttgccgtgtcacagtgagctgcaccttgctctgtcccccgcagagtagatgatgtggtgggccggcagggcaccccaaaccacgaccataaatagcctgggggaggagtggggtgagggaccttctgcaggaaagagacatggatgttgctgcgtcactaccacagagatgccctgacaccgagaagagcaatgtgtgcagaatcatcatctttggagtctaaaaaaagtctggtagcttttaggagtgtaaacaggcagacggacccctgagttcagtgcagcgagcgaagcaagtgcacacggacagacggaatccatgtgttcagtgcagcgagcgaagcgtgtgcacacggacagacggaatccatgtgttcagtgcagcgagcgaagcgtgtgcac

SEQ ID NO: 389297 - DNA, 1725 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389298 - DNA, 1643 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389299 - DNA, 482 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggtgagttgagacgcaggaggctaggggcagctttgagccctgtcccaagagcctcggtgaaggaaggggccccgggcgcgtctccactccaagcctcactgggggctgggttggccgccccttccgatctcgttaaaggctcctccagggcgtagcccttccactgagaggaaacccctcccaggagggtctgggggccccaggcagagcattatcagtgtccctcccccaacagaaagcatgggtgggggtgggggcgctgctggattcctgctctggtggaggggaaacttgtgaggggctggtaagcgccccctccgaagcctggtgtgtgcgcggggggaaggaagttagt

SEQ ID NO: 389300 - DNA, 290 bp, Homo sapiens
ccgtaccagttgcgggaacattcttgggtagagtgagaggcctggggagggaagggtctctaggatggagcagatgctgggcagtcttagggagcccctcctggcatgcaccccctcatccctcaggccacccccgtcccttgcaggagcaccctggggagctgtccagagcgctgtgccgctgtctgtggctggaggcagaccatttttatttacttatttattgtctcactctgtcgcccagctggagtgcagtagcgcgatgacggctcactgcagccttgaactcc

SEQ ID NO: 389301 - DNA, 1567 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccactgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389302 - DNA, 1515 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagacagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389303 - DNA, 1488 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389304 - DNA, 1070 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgtaattcctagctgtcgtgggatggagggaagggcggctgggagcagagcaggggcctggggtggggcaggtgctgctggttcaggaataggaagaggggatagggaggagggagccttggccctgtgatgggtgggccccacttcaggcaaacttagatggcaaaagagcaatctggatccgccttagccagatacataagggtatttgccttcactttcagccagcattccccccagcgatcctagccagatattacagatgatttgtcacttacacagagagtcacattgatatagctttaaaacttgggctgaaggaggttgaggctgcagtgagctatgatcgtgccactgcacttcagcctgggcaacagagcgagacctattaaataaataaataaatattaaatctattaaatattaaatattaaatctatt

SEQ ID NO: 389305 - DNA, 1566 bp, Homo sapiens
ggaggagacgcagcagggagaggccccacgtgggcagctgcgctgagagtcagcagcacctgtcccccaggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389306 - DNA, 1207 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389307 - DNA, 1077 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389308 - DNA, 1623 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389309 - DNA, 1745 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagaagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389310 - DNA, 818 bp, Homo sapiens
ggtccgcggggtgcgcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgtaattcctagctgtcgtgggatggagggaagggcggctgggagcagagcaggggcctggggtggggcaggtgctgctggttcaggaataggaagaggggatagggaggagggagccttggccctgtgatgggtgggccccacttcaggcaaacttagatggcaaaagagcaatctggatccgccttagccagatacataagggtatttgccttcactttcagccagcattccccccagcgatcctagccagatattacagatggtaaccctcgtgccgaattcttgcc

SEQ ID NO: 389311 - DNA, 1459 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccaccagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389312 - DNA, 1940 bp, Homo sapiens
  misc_feature (15)..(15): n is a, c, g, or t
  misc_feature (541)..(541): n is a, c, g, or t
gagaggcatggggcnggcagggctggagaggtggcgggcaggcccgggaggtaagaggaggctggcaggggaggtaggggtaggctgacagagaagtagggagctggagagaaagagggagggagggcagggtgggaagcaggtcgggggttgctgggcagcccctctgcctgcctgacccctgcctggttccacagggcactacctgaaggccccttgcacggagccctgcggcaactccacctgccttgtgtgtccccaagacaccttcttggcctgggagaaccaccataattctgaatgtgcccgctgccaggcctgtgatgagcagggtgaggggcttctcagtgcttggcagggagttcctaaggacaggcctttctgaaggaagtggctggctcgggcccaaacttggggtgtgagggtcctgcacccacccttgccagaaccctccaccctgatcctccttcagggtgcccttgccccttctctcttcctggtgaccttcccatctctccatgtgccttggcctctggtcggncttaatctctgagcttctctcttttttagggtagccctgtacctgtctgtctttcgcctatttctgtctccattatcttgggataatgcctctgcctctccatgggagcctttggccctgactaactctccactccccatctccctgcacccccaccagcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389313 - DNA, 1324 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccaccagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389314 - DNA, 1522 bp, Homo sapiens
ggtccgcggggtgcgcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaa

SEQ ID NO: 389315 - DNA, 354 bp, Homo sapiens
taccatgtgggttttctccttgcttcagctctccttataattatcagagagaaacattaagtgaggctctttatttctcatgcttttaggtgttaaatttctataagcttaaagtaataacttcaagaactcaatagatgaggtaatgtgctatgagaaatggaagtataaaattacttctaaataatcttagcatactgtgaaggatactgacttaggtatataattacattgtaaaatatagccttgtttttaaatatgagagagaaaagaataaaaggaaaacctaaaagttacagaacacgtactgacacacatatatgtacaaatgcatgtgtctattcatggctgtca

SEQ ID NO: 389316 - DNA, 911 bp, Homo sapiens
  misc_feature (497)..(497): n is a, c, g, or t
  misc_feature (501)..(502): n is a, c, g, or t
  misc_feature (557)..(557): n is a, c, g, or t
ggccccctccccggaaccggcggtcgagctacggtcgcggagcagtggaaccgagactgccccgcggagccgccggtatgagcgcccctcgccaccccgtgtcccaggcccggcctttctgacaagagctagacttcgggctccttgaggatattcagttttgtatgtttgaatatcctctcaccatgttcagcataaagtaccattcttaatgattatcctcaacaagacaggtgtgagagggttgctgttgtattgcaatcatggtgcagaaataccagtccccagtgagggtgtacaaatacccctttgaattaattatggctgcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaagattgcaggagtcgattatgtncatnntgtccagaaaaatcactgaattctcgggaacgtactttgcacattgaggcttatnatgaaacgttttccaatcgggtcatcattaatgagcattgctgctacaccgttcaccctgaaacatgaagatcggaactgtattagaacagtctgcaagtttagcatattaaatctttctttggtcttcgaaagtacagtggcaaaaaattgcaatgaaacaatataacagcaacatcaacaacaggaaaggaaatcatccgaaatactaccatcgccaaatagaacgaagaaggcatacacctttgtgccccggcggagagccgcctaccaatcacgaccctcttcaaaagaatctcaacatccaccagaacacagcaggctcaagggccgacgcatccagaagatggcccag

SEQ ID NO: 389317 - DNA, 105 bp, Homo sapiens
gatcacttgatttttaagaaattaaaaattgcactaggtagaaatagtgtaccaggcaatagtccagctttagttttgtgtcatttttggtctctatttaaagca

SEQ ID NO: 389318 - DNA, 1148 bp, Homo sapiens
tacggaaagactagggtgtgaattcagcaatctctggttaggagaaaagtagcctagtttattacttcttcactacttttgcctggatgacctgaattttaatcaagaagttctttcctctctatatgcgctcccccattttcccacttttgtattgactttcccactattgtatttctaatgcaccttcttaatcactggagaaagctttgaggcatgtaagaggtcctagcaccattttcagtcttaaagtttcatagccaccagctttatgggactctattatcagccctttcaaacaaattcttcccttccctcacaatcccaagctattgatcttttctctaaggaagccttttgtattactaattaagactaggtgactatattaaaacagggttatcttctaaaagatttatataaatgataaaacagaggctaagtatttttgtaaggacagcaatttgaagtcagttaatgcctagagtgactgtttcattcttctgctatggctctggtgacttcctgataattctgtccgagcccctgtgtccagttccaggacctaagaatggaagagctctggaggctgaaggtggaagatggatccccctttcagggacagtgaaaggagggttaatctttcctgaagctgttagtctggtatctattagcacacatgagaattagaaaccttgcaactttagaaatagtatctgtgtagtaaatgctgtctgtgtaccaatttgtatagcttttaatagaaatatcttatttttggatggaaaatgtgtgtaagcttgtgactaaaatagttctggatggaagaccattcagtatcttctgaaaaaaaaattgtcttctggaactaaaacatgaaaaaaaaacctatccattattgcttttttttaaataaagaaaaccagtgctgtgtaatccatattttaccaatattaattatgtcttagaaccatttaagaatgatggtttacatatcctattttaaagtcaagattttaaagagcttttatttgttattactaattattgggagaatattgaaaaattttcaatttaaatgttgaattaaaaatgtaacctttttggctgggtgcggtggctcacgcctgtaatcccagtactttggg

SEQ ID NO: 389319 - DNA, 1094 bp, Homo sapiens
tacggaaagactagggtgtgaattcagcaatctctggttaggagaaaagtagcctagtttattacttcttcactacttttgcctggatgacctgaattttaatcaagaagttctttcctctctatatgcgctcccccattttcccacttttgtattgactttcccactattgtatttctaatgcaccttcttaatcactggagaaagctttgaggcatgtaagaggtcctagcaccattttcagtcttaaagtttcatagccaccagctttatgggactctattatcagccctttcaaacaaattcttcccttccctcacaatcccaagctattgatcttttctctaaggaagccttttgtattactaattaagactaggtgactatattaaaacagggttatcttctaaaagatttatataaatgattagagtgactgtttcattcttctgctatggctctggtgacttcctgataattctgtccgagcccctgtgtccagttccaggacctaagaatggaagagctctggaggctgaaggtggaagatggatccccctttcagggacagtgaaaggagggttaatctttcctgaagctgttagtctggtatctattagcacacatgagaattagaaaccttgcaactttagaaatagtatctgtgtagtaaatgctgtctgtgtaccaatttgtatagcttttaatagaaatatcttatttttggatggaaaatgtgtgtaagcttgtgactaaaatagttctggatggaagaccattcagtatcttctgaaaaaaaaattgtcttctggaactaaaacatgaaaaaaaaacctatccattattgcttttttttaaataaagaaaaccagtgctgtgtaatccatattttaccaatattaattatgtcttagaaccatttaagaatgatggtttacatatcctattttaaagtcaagattttaaagagcttttatttgttattactaattattgggagaatattgaaaaattttcaatttaaatgttgaattaaaaatgtaacctttttggctgggtgcggtggctcacgcctgtaatcccagtactttggg

SEQ ID NO: 389320 - DNA, 558 bp, Homo sapiens
gagtctacatgttaaaggacaaccttaactgtgaatttgctttctctgcattggacccttaatgttaatccattgtagtttattgggtgattatagtaaagaggtttttggtccaggaggagtatgaaggcattctgtaaatagcgtcctgcccatcctgacatggaaatgtttgtggcctttccctcttattactaatccctcctgcacaaaccctctcacatacttactcattttctatactttgtgatctattaggcactaaccaattttatttgtaagcttgtcaatatctgaatcttttaaaaataagtattagtgggctgggtatgttggttcacacctgtaatcctagcactttaagaggccaaggcagccagatcacttgaccccagttcaagaccaacatggcgaatcctcatctctactaaaaatacaagaaattagccaggtgcggtggcatgctgttgcccaggctggagtgtaatggcgggatctcagctcactgcagccacctcagccccccaagtagctgggaccacaagtgcatgtcgacgc

SEQ ID NO: 389321 - DNA, 665 bp, Homo sapiens
cgggagcagaacagctttggtgaggtggacaggaggtgacctcgcgagcagacgcgcgcgccagcgacagcagcccgccccggcctctcgggagccgtggggcagaggctgcggagccccaggagggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgaaggactacatggatgccatgggtgagaagcaaaaatggatgcagagtttcagaaaagatggaaaagaataaattgtgcagaggagcagaccgaagcgcggaagaagcgcagaagttaaaagagaaga

SEQ ID NO: 389322 - DNA, 425 bp, Homo sapiens
ccagccccctaggaataaggcctcttagaaagacagagagaactagaagttttagacccaaactatttggaattcattctttttctacggattttctcaaaacagtgttcttgttaccaaggggtccttgctcccagagctcccaagacggtggtgggccacttccaagacggtggtgggccgcttccaagatggcagaagccacttccaagatggtggcaagcctcatgttctctgacctggggttcttggcctcacggattccaaggaatggaatcttgggccatgcagtgagtgttatagctctattagaaaccatgggtcacagaagagaaccgtggaacccagtgactagtgttcagctcgattaggatgaatccaggcatttagccatgcaggaacaatggtgagtctttagcccaatg

SEQ ID NO: 389323 - DNA, 518 bp, Homo sapiens
gaaccagggcatttattgccagggagcacgttgaatcatgagaggggccagtatctcccagcagatgccagcatctgcccagagctcttgtggcctttctgggtctggctggcactcactcccaattcctcttgggacaataaaacttcttcccatttcccccaacaaagcctggcttctatggcaccccactgcccaggttcccaatctcaaggcaactgtcggtcaattttgattcattcagcttatacagtatgatctcaaacttgcacagctgctggcaacatagcctcacaaatttctatttaattgcatgaacggcatgtaatagactaattctcaatatctggttcctggaaaaatatgccctgctcactgttctcagtgacagggggcccaggcggtcagcactctcctgtaggacgggctgcaccagcagatgtaactgtccggaagaaggatatccagccatgtttgatgcttcgcagagctcacaacacaggaggagaatcactccc

SEQ ID NO: 389324 - DNA, 192 bp, Homo sapiens
ttgatttgattctcagcttggttgctgttggtgtatagggctactgacttaaatctaagacccaaaaccataaaaattctagaagataacattggaaaaacccttctagccattggcttaggcaaagacttcacaaccaagaacccaaaagcaaatgcaaagacaaaaataaaaataaataaatgggactca

SEQ ID NO: 389325 - DNA, 525 bp, Homo sapiens
accctggggccagatcaggcaagcctcatatgacctacatcaattggacatttttctatagtcagtgtaacgtcattgaaaggagtcctgtaaacagctgaaaagattaaagattactaagctggtagcagcctgtgggatggtttggtgtaggaaagttctagagccaaggagtcagattggcaagctaccgtaatcatctaggcaaaagagtcggggctggctgggcaaggtgggtcacacctgtaatcccagcactttgggaggccgaggcaggcaaatcacctgaggtcaggagttcaagaccagcctggccaacatggtgaaaccccgtctctacttaaaatacaaaaattagcccggcttggtggtaggcacctgtaatcccagccactggggaggctgaggcaggagaatcacttgaacccgggaggtggaggttgcagtgagctgagatcgcgccactgcactgcagcccgggcaacagagtgagactccttctcaaaagcaaaaaaaaaaaaaaaa

SEQ ID NO: 389326 - DNA, 450 bp, Homo sapiens
aagtaggaaggcatatattttggtagtatttgagtccgcttcttagtctgggtaacataccttagggggatacagtggtgtggcaaggagtaggcaaactcacagaattaaaatatgcatcttggtgcatcaattttccacaatggtaaaataagatactattttttaatgtggaagccaatagataagagtttagaatatattgcatatttgacataattttttaaagtaaattacatgtagagggttatcctaaccatctcctcaaatcctctccttcgttcttagatacacattggaagaaatatttgagaaaacagatactgaagtttttatcttatgttgggacttctgcaatgtaaagtaggttctgtctccagttttgtgccaaggagagaatggtgtccctacagtgacgtaggggctatgggtgccctccacacaaatatt

SEQ ID NO: 389327 - DNA, 410 bp, Homo sapiens
gccttgatacgcccaccgcacccccacccccacccccagctttggcattgaaattcttgtgtgtggtgcgcttgaaaggaatcccatcctgcctgcgtctgcggaggctcccggcccgtgtttggtcagcaagcaacagtgggtggtcgggctgctgtgcaggacaacggcccgctgtgcgcaggaaaatgtgttcaaaggtgtttaagggccatgaggaagtcggccacccttctgagagtctgaggctgcagatcagtgttccctacactattgtagactgtgagaaaacttgctgtagtaggcatgaaggatgagaaaatacagtaaccttactcacctggctccgtgtctgcaggcttcccttaagaagggtctcttctgccctttttgtggtatagagtctgtta

SEQ ID NO: 389328 - DNA, 338 bp, Homo sapiens
cacgcagtgtcctctccaggcaggcgcacccaggagggccaggagaagcaacactgtttagcaagggtcagcaacctctcaaggcctcaatgccacagctgcctccttaggggagggatgaaagaaggaagaggaagagagagggatagcgttctaggggtaaaagggccgtagaaagccaaagggtacgtacacaagccatggcccagtgcagctgcgccatggagcagccttggcctctggtgtctccctggcatgctcccaggactctgcccctggcatgaaggtcgtgacagaaacggggcactaagaaatcctcactggaagagtggcctccg

SEQ ID NO: 389329 - DNA, 482 bp, Homo sapiens
tgtgtctgctctgtgtctgctctgtgtctgctctgttgtctgctcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaa

SEQ ID NO: 389330 - DNA, 820 bp, Homo sapiens
agccctgggcaattcaccttttctttaaatactcatgtcacatttgtgctgttgccaatgcttctcagaccctccagatgaggacatttccctgaggaggtggctatgatggtagaacttacaagacttcagtggacataagttgtgcatctgatcattatttaaacatcagaacaaatgaaaaagattctaaggagaaaaattaccacaagcattcaggcaatttgaaaccaaagctgttccagtacaagtatcacacaaagacattctggagaatggcagaaaagtgagcgaagccagaaaaacaacacttcaaaaggtctgtggaggagacggggtcaaggtggcaggcaagatggtcaaatagaagtagcttcagtctgcagctcccagtgagatcaacacagaagcctctgctggtgatacccaagcaaacagggtctggagtggacctccagcaaactccagcacacctgcagcagaggggcctgactgttagaaggaaaacgaacaaacagaaaggaatagcatcaacatcaacaaaaaggacatccacacaaaaaccccatctgaaggtcaccagcatcaaagacaaaggaaacaatgccaagaatacgttaatctaaacccatgatgtttctacatctcaaagaacagagagaaaaggaaactggagagaggccagaagtgaccaactctattccctcatttctgtgttatactccctttgtctaatcttccctaccctaccaggtggtttaagaattttatcctttctccagactagaagaggaagtgggggccggaattaggtgtatac

SEQ ID NO: 389331 - DNA, 446 bp, Homo sapiens
agccctgggcaattcaccttttctttaaatactcatgtcacatttgtgctgttgccaatgcttctcagaccctccagatgaggacatttccctgaggaggtggctatgatggtagaacttacaagacttcagtggacataaggagacggggtcaaggtggcaggcaagatggtcaaatagaagtagcttcagtctgcagctcccagtgagatcaacacagaaggaaacaatgccaagaatacgttaatctaaacccatgatgtttctacatctcaaagaacagagagaaaaggaaactggagagaggccagaagtgaccaactctattccctcatttctgtgttatactccctttgtctaatcttccctaccctaccaggtggtttaagaattttatcctttctccagactagaagaggaagtgggggccggaattaggtgtatac

SEQ ID NO: 389332 - DNA, 423 bp, Homo sapiens
cacccatgaggagaggatttgaccagccccagccagagggaaactgcccatcccagcagtccagaacctgagttgcagccagccttactactatgggctaaagtgctttgggatcctaaataaacttgaaagccagtcttatccacaaggactgcaattcttgggcaagtcccagtgctgtgctgggctcagagccagtagacttggggtacacgcgcctggtgagagagtagctggggcagctaaagaattatttgtgtcaccccccctcccccaaccttcacagtcccaggcagcacaactcgcagctccagaagactctttcattccacaagaggacaggagaggaaggagtgaagagaactttatcttgcaacttggataccagctcagccacagtagaggaggtagagtcgtgacaca

SEQ ID NO: 389333 - DNA, 364 bp, Homo sapiens
tctctggccattcacattggtcacatggccaagcccaacatcaataaagtgcggaaatatatttcatctaccctagtaagaaggagataataccaaatcactttgcaaaagggtgtgcaattctagaacaagaaaagaatgaagaattggggacaataatattctacaatattttttgcaatacatcatagtagacatttattacttttaatttcataaatatacttgcacactttgaggaataagctcatgataattaaggtaaaataatctacttgtaataataatttaaagttgaaaatttagccagaatttatgccagtttatattatgccagtttaggttaaacatacatttaaaaatt

SEQ ID NO: 389334 - DNA, 291 bp, Homo sapiens
ttattaaaatattgacattcctcccaatgcttcatttgtctagataaatgtagcccatggcacaaaaatacgttcttaggctgggcacagtggctcatgcctgtaatcccagcactttgggaggccaaggcagacggatcacttgaggtcaagagttcgagaccagcctggccaaaatggtggaactccatttctactaaaaatataaaaaattaactaggcgtggtggtgggcgcctgtagtcccagctactcaggaagctgaggcaacagaattgcttgaacctggggg

SEQ ID NO: 389335 - DNA, 309 bp, Homo sapiens
gaaatatgatagttcttttcaaagttgtggttgtatttttgaaatcttgccaaactggggatcattaaagggctgtggtattatggtgttaggttgaaatcttgacattttcatatggtttaacctaaaatgtaagtgacttcatttagaattcaacttttgaaactgtctgcctataccatatataatggccaggacactcagtaaatggcaatgtgcattttgtctaaggaatgacgactttaaaaaccaaagtatatgtgggttttacttaagaaacatggaaactagtgaaaatacagttgactt

SEQ ID NO: 389336 - DNA, 211 bp, Homo sapiens
ggctgacatcttggttacaacttcgtgagtgaccctgtgccagtagcacccagctaaatcactcctgaaatccagatccactgaaactgtgaggtaatacatatgtattgttttaagccattaagtttggggtatttgctacacagcaatagataactaataactatattatgacagtacaaggaaaaaaactgcctcgaatatatttttt

SEQ ID NO: 389337 - DNA, 1247 bp, Homo sapiens
ccccaggcgtgggaagatggaaccagaacaattcgaacgagcagagcaaaacagatcggaattgcagacttcaggtcgtggcagagaaaaccagctgagacagggcgccacttactagctctgaaagtctaggatattttgccactggaagaccagcagacaatgtcatgacaactcaagaggatacaacagggctgcatcaaaagacaagtctttggaccatgtcaagacctggagcgaagaaggtaatgaactcctacttcatagcaggctgtgggccagcagtttgctactacgctgtctcttggttaaggcaaggtttcagtatcaacctgacttcttttggaaggatcccttggcctcacgctggagtgggcacctgccctagcccacagagctggatttctccctttcttcaatcacacagggagcaccactatgcaaagacctcatcacattcacagccgtctccgcagagcctcgcactgtgcttggcatatagcaggtgctcaataaatatctgccaaatgactgaatgcatctcgctagcctcaggatgccaccaggccctgagggagccaggaagatcagaggaaagcttttggattcctgccacaccttacattagcaacatcttctccgagtcctgacagccagcctcctgggacaccattcaagccagctgaattccggtcaccgcttcaccttggaaaggcatccgcagccctcaccaagcggccccgtaattgacgtcacagcggggccaggagctgccctgttaatatttaatgtggccttcactgcgcaaaatgcagcctctaagagctggaggggccgtgcagagtctccatggggttgtgaggagggcacagaagggaaagggctttataaaccataaagcgcccaacagatgagcattctgccgacccatttcagtccctggcttaactcagaaagagccggggctgcacatgcctgcagtgggacaagaagactgctgaccaagcccgaacactaaatcaatgggggattaggggctcctgggtacattccattgagacagcgggagagcagagcactggtgccagcccaacctggactccactccaggtttgccccctgcacagctgtgtgactgggtcagcaagtgcactgctgagcctcagtcccccttatctgtgaaatgggaatgatgctttccttgtagcactgctgtgaagattcaatgaaacgagtgatgccgaaga

SEQ ID NO: 389338 - DNA, 4160 bp, Homo sapiens
ttgatttggtatagtgggaacatttgctttggagacagatgaactggattctgatcgtgaccctgctattttctccttgtgtgactttggagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggcctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgcaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389339 - DNA, 626 bp, Homo sapiens
  misc_feature (555)..(555): n is a, c, g, or t
tgcatcaacgcgttgggagctctccatattgtcgacctgcaggcggcgcgaattcactagtgattatcccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcatacccagganccggggataatcactagtgaattcgcgccgcctgcaggtcgacatatgagagctccctacgcgttgatgca

SEQ ID NO: 389340 - DNA, 2654 bp, Homo sapiens
tccggggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggcctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgcaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctagaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389341 - DNA, 731 bp, Homo sapiens
tccggggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatgaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389342 - DNA, 2970 bp, Homo sapiens
  misc_feature (2899)..(2899): n is a, c, g, or t
tccggggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggcctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgcaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcatacccagganccggggataatcactagtgaattcgcgccgcctgcaggtcgacatatgagagctccctacgcgttgatgca

SEQ ID NO: 389343 - DNA, 4206 bp, Homo sapiens
tccggggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggcctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgcaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389344 - DNA, 1862 bp, Homo sapiens
tgcatcaacgcgttgggagctctccatattgtcgacctgcaggcggcgcgaattcactagtgattatcccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389345 - DNA, 562 bp, Homo sapiens
ggctcaacaaggttatcagtgagctgaatggaaaaaacattgaagacgccattgcaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 389346 - DNA, 330 bp, Homo sapiens
aatctaatatttagatcactataccacagtagagcaggtattcaaaatgttttaaagttactgctgcctaaagttgttcttctagaacgagctcttattttaaacgctatttgggtcagatgatggggtcactgtaagatggataacaactctaacagattactggttatacaattcgagtgttcaaaaataaaatgccagtggtctactctcttactccttgccgaaccaattttagagtggaaacaaaaaggacagagcactgggcaacccattcaggtccccttccacactgttgaagctttgttctttcgctcttcacaataaatc

SEQ ID NO: 389347 - DNA, 289 bp, Homo sapiens
ttttcttcttatggaagtgtgcctcatgggtattaagtattgcagtactttgtagactttgtctgacttcgtgaagcatttctagttttagaagagtgctcctaattcaaaggtaggggaaggcatgtgcaaaaaagccgccctttccactctatattctgctgatcagcaacactatttgtcatcaaattaccggaacagagactatcttgagtcagaaggttatgttgttgctctctgttcttaggaatgtttttgtactctgagagtaaagataatttttcctgtt

SEQ ID NO: 389348 - DNA, 831 bp, Homo sapiens
ggccagagagtctttattacagtggtttgctattgaaatgtgcaaacaatatgatatatgagtcagtactacagactggttaaacagggtacaacatctaaagccaagcatagtggtatgtacctttggtcccagctactctggagactgagttgggaggatctcttgagcccaggagttccagagcagcctgagcaatgtagcaagaacccatctcttaaaaaacaaataaaaacagtccatgaaacataaagtttgaaataaagattaaaagatatatgccaggaaaatgtaaccctttcccatcccacaaaaaaaaaagaataaataccagataacaaggaatttaagacaaaaaaatttggatataaaatggtcatgtattatgataaaagttctaattccaccaggacaaaaaaaaatttaaacttgtgcgtgtctaaatacataattttccatatacataaagaaaaaacaatgtaactgcagagagaaataaataaatatatcatgattgtagaaactttgtcatacctctctcagtagttagtctatgaaaataataataaaaaaatgataaggctatataaaatttggacttaagataatttaaaagctttaactattcaatgtatattaattggtgcatttaacaactggaaaacacacctttgctttccaagtactgttttataaaagttgatgacatataaagtgataaaaccagttctaacatatttttaaaaacaagtaccatagagaatatgttctttgaacacaatgcacttaagctagaaatcaataacaagataacataaaatatcatatatt

SEQ ID NO: 389349 - DNA, 333 bp, Homo sapiens
agcttcccaaagtgctgggattacaggcgtgagccactgcgacctgcctatcctcacagcttttatcccacttgattaaatgcttccagtcagtggttgctttttcccatgatgcttttttaaatagataagattgaataaggtacacaatagctgcgtattcctaaataatatctttcagaaatgtgctcatcatacatggacagatagaaatagaactttcattctgtagtctcttttattctgagagtgtgtcactgagggtgagtattcagactggtgtacatgtagcaactgtttggcagagggaaaagctgtctttgttgtcagaga

SEQ ID NO: 389350 - DNA, 463 bp, Homo sapiens
ttttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtgatccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaaataaaac

SEQ ID NO: 389351 - DNA, 787 bp, Homo sapiens
gtggacttccatttcctctctgtaaaatgagagaagtgactgacattgggtagttttctaaggctcctttcaaccataagagaaaactgggaagtctaagtagctcaatagattgcttttttctgaagatggagggaagattggaaaattcagcctttactagaataaatggttaacatacaatttttttcaacaagtttatttaatgtcagcttttaatttcttttatttatttattttttctgagacagagtctcactctgatgccctggctggagtgccgtggtgagatcacagctcactacagcctccgcttcccaagttcaagagactcttgtgcctcagcctcccgagtagctgggattacaggcacccaccaccacgtctggctaattttttggattttgggtagagacaaggtttcaccatgttgcccaggctggtctcgaactcctgaactcaagggatccacccacctcagcctcccaaagtgctgagataacagccatgagccactgcacctgcctcttaatttctaattgaaataaaagtgtaaatttttccatttttacttccccaaagaagaagaaaattccttttgaggaaatgaaaatgtttattaatgggccccagatatatctatcaatattcctttttgatccaaaagatgtaactttttattatgggcttctattacatcaatagttgggatactgtattggaaaccatttagttttaggaacaaaagggtaaatattaacctatatggtgttattctcaagaaact

SEQ ID NO: 389352 - DNA, 627 bp, Homo sapiens
atatattctagctgtcaaacattatggcacatttttctgtttctgcctcattagaaagaatcactaggagagattctttgcagtaattatcacacaaacttctcatcttgattaggtgttatcttctggctcatttggcaggaagatttgaggagcaaatacccataaacttcacgatcacctacaggctataaggaatgagattgcatatacaggctggattttaagttgataatgtttcatactttacttggaaacatagtcctgaagcgttgcatattggaaaggatattaatgttatattaatattagagatgtcatgaatttaactcgtatatctgctatttactggttttctttgattctgggatagttaccttaattttctcatttgtaaaagtctacaacataggatagcaaggcataatattttggggtgatgaaatgaggtgctctatttaaaagaatatttcttacacagacttataaagaaagatatattgtatcatcagtgatattaattcatgggactccagtttggtggcccatgccatatgattgtagacagtattacacaaaatgttaacaactaaacatcgcttaccctaggagaaagattttttaaga

SEQ ID NO: 389353 - DNA, 367 bp, Homo sapiens
  misc_feature (54)..(54): n is a, c, g, or t
ctgcagtgtagcccagtgctagcaggacacgtgtatacctgaggatggcaaggntgctggggctcagagtctgcacttggttttggttttctttgagacaaggtctcgctctgtctccaggccggagtgcaatggctgggaaatcagatcttttctggactgaaaacattggccagatgagagtgagacaccgcagtaagcgtgcagggttccagatggtggcagtggcacacggtattatttattcagacctcttctctcccgcattctcttagtagcaggagatttcacatgcaggagccaatgtacatgtatttactttgcctgacttctgtttttttgtgtggattttttttattttattttt

SEQ ID NO: 389354 - DNA, 143 bp, Homo sapiens
agtgtgtgctgtaaggtcgacaatggtggccttatcttagtggctgtcaatctctctcctggactcccgcagtcctctcctaactgtaccccatttcttcttccttagtgtttcacagtggcttaccacatggtagccagggc

SEQ ID NO: 389355 - DNA, 482 bp, Homo sapiens
atgtcattttcccatggcagattatatcattagcccatgaatatatctccccaagctaagaatctattaatactgtctgtagaggtgtctaataaatattcaaagattgagttggagcagatgatgattaagagtaagtgtatgtttgtaagtctctggatttccataattgtaaaagaggaaaaaagatattaggaagattaagttgctaaagttttctgttcaaataatatgttcaataaacattagtaatttgacttttattttctgtttatctcttcataaggtgcaaaatgctgaatgttttacgtcttaatgaacttaggagcaattaaggagactcatcatttcacaagcttgaaatttaggctattaatatttgatcagtccatttttatcttattaggtaaccattaattttagagttttaaatgaaactgaaaaccagtagcataattcgaccatctgttaaaaaaaaaaaa

SEQ ID NO: 389356 - DNA, 401 bp, Homo sapiens
tgaagaaggaaggtaggaacggtagaaagaactccggcaatgaaaggtggtgcagacaaaggagttcaagtgttccgttctggggccagaccgcctaaattccaatcctagccttgacttttagtatctatattatcataaactagctctttgtgtgtctcagtttatctgtaaaattagggaaacaatagtgtcttctccatggaactgctgtgaatattaaacagctttatcatacataaatcatgtagaataatatctgccacatgattagcactagaaaaatagatctcattatagctggttcatcagaagcccagctgtcaactggacttgtggctggtgtctgaattaatgggggtgggcagccttgcagaactgagcccataacctatagggtc

SEQ ID NO: 389357 - DNA, 596 bp, Homo sapiens
tttggtcgctcagaggatcccccagtcctacacttgctgcaacctgggggcagctgcgaatgaaacagtaagcattgcttcaaatcatatcttgagctctgctaattaagaaatgaagtccaggcagacctaaatccttccctttccttaagtgtcagacactgtcccatacatgttaatttccagcagtgcccaagagactcccaataacacagaacactagggtaaagatgggcttggtatccgaggacctcacactctcaagtgcaatgatagccagcagcgatgtgcacaaacacacaatatatgaatacttctccttgccccatattagttacagggaagaaaagaggagtctaaaatatattctgcttttgccccaagaggctttatttaattcactttagtgcattttgcccactatcatgtaattattgtgtatcaactgcatgggaatatggagattgtctcagcctcaagtaagtcacagcagtaataggaacagacagacaagtatagcaataggcaattagcctctccccatatctatcttgacccctctgcattagcttcttcccatgcagcaagtgtatgag

SEQ ID NO: 389358 - DNA, 711 bp, Homo sapiens
aaaataaagcagaagtaattttaaaatgacaccataaaatgtgctgtggttttggctttcttctttctctttctcagagcaccctttgtgcaagaaggcagtgctatgtcatgaggataatcaagcagccctacagagaggtccacatggagagaactgaggcttgcttgaactctgtgagatgttgttttaatttaaacaacaaaatttaaactaaattttgggataatttgttacagactagtatataaataatatatctttttaaaaattatgttttctatttgtttctggtttacagaaattaaagtttttacattattctcctagccagttactttatttagctctcttcttaatttcagtaataatacatttcaatagattctattgagttttatgtagacagtcatcttctatgtacttaatggcagctttgagtctttctctccaatccttatttatttttcttctccatgcagatggcttagtctttgatatagtatcaactagaaaaaatgatagtgagtatccttgttctgttcttgattttaaggggattttctaatatttttccatttaagaataccatcttagaggtttctgatggatatccttattagattaagggagttctttctaactcctggttgcttctgtcaagatacatacacacacacacacacacacacacacacacacacacacaca

SEQ ID NO: 389359 - DNA, 243 bp, Homo sapiens
gtttctgtatttctaccaactggacggccccacctggacctgccaaccagttctgtggtctccacccaggaactgactcagcataagagaagagctttgactccctgttatttcatccctgagccaaccaatcagcactcctgattcactggccccctacccaccaaattatccttgaaaactctgatccccgagtttttggggagactgatttgagtaataataaaactccagtctcctgcc

SEQ ID NO: 389360 - DNA, 365 bp, Homo sapiens
cttattcttttcctgaggatgttggttttatatggattgtctttaagcatcacttggaaacgctacaaataatgcagctaaatgtttaagcaattaggaaataggaatttttaaatacagaattttgcactgcagagtgtttacaagtattaaaagattgtattacacaactgttgttaaattctagtaagataaattgatactaaagaaaacaaacccagaaagatcaagtgacttggatcacacaacacaggaattaagaaggaaattagtattctttgttgaatattttccatttgaatagttacaggaaaattatttgcatattttacaaattaatgtgtattgacatcatagtggaaaat

SEQ ID NO: 389361 - DNA, 363 bp, Homo sapiens
gggagtggagagagaaaggggggggatggagagaagggggagtggagagagaaggggactgttaccctatgcgtagatacaccggttccctactggagatcaaaggtttccggagtagctgattcatcaacacccttgaaatctggcgtcaatttcacaaagagaaatttctttctttctttaagtttgtttgtttgtttctctctctctcttttctttctttctttccctttctttctttctttctttctttctttctttctttctttctttctttctttcttttctttctttctccttccttccttctttccttccttctctcttttcccttcccttcccttcccttcccttcccttccct

SEQ ID NO: 389362 - DNA, 437 bp, Homo sapiens
aatgggcacagatgcagggaggtgggtagctatggtgtctggacatagggaggttctcttctcattgcttctgttttctcggtgaaataagcagctcagtcattagctgggagtgagaaaccagaggaagtggaaatttgaggttagagaggaaggtttaaactagtcctctagggaaatggaaagcagatggattagggcaatgtgggtggattgctagacagcattaagagtccctttaaggttagtgaccatacatttaaggcgaaaatagtcagtgggattgtgtgcttttgtccagctgtggtcagccaccctggtggagatgcatagtggatagagaattgaatttaaccaggatagaggttccaggtgaaggccctgaagggagaggcaagagagctgattgtgtatgcaagggggtgagtataatggtg

SEQ ID NO: 389363 - DNA, 457 bp, Homo sapiens
gagtggtggcttttccatcagttccatcagttgctgggggatcagcaagcagctgactgacggtaacaaaaccaaggtcatagctcctctaggctgcagcgtgtgtgctatgtccctcttctctctgtggaaatgcttaggcacatattccatccctgcccttcaagtctcatggtcgtgggatcagggcaaggacatctgatactgtatcatcagtcacgggctcgcaaagcaatgagatcaggcaggtgaagaattagtcccagaactacggaatcccacagagggaaggcccgctatgcggtgggccggctagcgtttcctctaggaagcaggtagagatgcccattttaccgatgaggacccagggctgagcaaagcccatgaaggtgggtccttgtgataggccaaatactgccccccaacactcacacccagaggtgcccttgtcccaatc

SEQ ID NO: 389364 - DNA, 358 bp, Homo sapiens
ccgcagcgggcttggctgcagcttggcttatatgaataacccggagagctctaaaacatttccaatgcccaggagtcacccttggagattctgaattaatgcatcattttttggcacttgggcatcagtatttttttattttaatttttgcatttacaaaattttagtaaaatatgtaacataaaacttactattttaaccattttaaagtgcacagttaagtgccattaagtacattaatggtattgtgtaaccatcacctctatctagtttgggaacttctgtatcccctacatggaaatcccttccccatcgtgagtcactcctcatttccccctcctcccagctgctgacaacc

SEQ ID NO: 389365 - DNA, 516 bp, Homo sapiens
ggtttgaattgctgtttcctggggacttggctgggcacaatctggggctggccgtggggtgatcggccacgggcccaggctgtgtctctgctgctctgggcgggctctcccctcaccttgaattcatgtgcaatggccccattttccgtgtccatgtgtgttcctgagtagtgggtgtttgctgatcacctgctgcccactctgctggctctgctcttctgtgtctgagggtaaagggtgtctgcctccctttcccctgcaggaagggctggactctcatcccctgatgaatggtgctttgtccttatagaatgatggaagagggacactctttttcttttaaacctgctattttaaccattttaaagtgcacagttaagtgccattaagtacattaatggtattgtgtaaccatcacctctatctagtttgggaacttctgtatcccctacatggaaatcccttccccatcgtgagtcactcctcatttccccctcctcccagctgctgacaacc

SEQ ID NO: 389366 - DNA, 707 bp, Homo sapiens
agcggattgctgctctcaaatttagataaccagtcatttattcactgggaatctatgtctattctgcccttcattcattgccttgcttacttttaaaggttcatatgaggagaacatttgaatattgtatttgtaacaattgaaatacaaccagatgtgcaaggatagtgataacaataggcataaaaaatttcatggaatgttcagagggtcatttgcccccaactagattttatgctctgaagaacacataagatgaaaaatttactaaacaaagtgaagggtctgaaaacaaataatagtgaatatgtataggaaatgctatttactagttttttttaaggcttatctaagccatgtaattctgtcccagaaatatacctaggttggtcataactacatctaaagtgagtgactttaatgaatattttaaatggtaattattacttatagtttatattgggtattgctttaaaactcaaattagattgaatgtcaacttgacattttatttgaccctgcaattcttgtgaaatactgtaaagggaatttatggttgttatagataaatttattttaaaaaatcacttttactgactgtttaacataataagatagataaatacctggtaaatttgatattcatcattaaaatatccatgcatgtgcagataaaaatatgaataactgctgactaatacctccta

SEQ ID NO: 389367 - DNA, 518 bp, Homo sapiens
ctgggagagggtgtcccgtgccctttgctggcagcatctgtgagttgcacagccctttgagcattgccagactgtgaggtgtttagaaaattccaggccagatgggagactgctgaaggtttgtgatgttgccgccgcctgcccacgaggggagtgtcctcccacccacactgggcaccgggtgcttggcttcctgagcaggatgtggtttctcattctagacctggtacaagagagggtagttttcacccaacagtaaacctggcaaatggcaatgcctggttctctggagggtccgtggagcccaggtcctggtctgggtttgcctgcgatgtggtctgagcttcactatgcccacgtgggaatggggacagtgggaaggtgggcttgcccagcaaccctatgaagactacgttctctccgtaatgtagcacaactctgtgcatgccatttaatctcttgcacctcagtttgtcgctctgtacaatgggggtgtggtttcttacgagttctgcttc

SEQ ID NO: 389368 - DNA, 162 bp, Homo sapiens
ggacaggccccgaagaacccgaaagtcacagaatcagagtgttatgactggagaggagcttggagatcgggtcttcttactcctagagctggacagaccctctgtcctgagtcacactgcctctggtttccatcattgatgcttactgaactcagaaatgag

SEQ ID NO: 389369 - DNA, 352 bp, Homo sapiens
tattttttttttttaagtagacagggtttcaccatgttgtccaggctagtatcaaactcctggccttatgatccacccgccttagcctcccaaagtgctgggattacaggtgtgaccactgtgccaggctcctggtttactttttggagccctaaattgtttcttcaggaggaaatccatgttcaattcaggttgaggaattccattttcactacccaggacactaagccatcaatttgaaaccatctttgcaaaaaatcataactgagaaaattattacagtgaaagagatctgacctaactgactccatcttgcttctaacctccaagctgcccttgttcattccccgcg

SEQ ID NO: 389370 - DNA, 448 bp, Homo sapiens
ggtctcttactcctggcctcagacggtctgcccaccttggcttcccaaagtgctgggattaggtgtgaaccaccatacccagccttatgcctgtaaacaatgtaaataatgctacaggaaaaaaagagatagatatagaacccattctgaaagaaaatttactctaggaaatagaacatcctccacatcaaatgccctatagtctaaaagaaattaaagagaaaaaggatcaatgaaaaaacaagtcaaagacaaaatgagacactacaataaaatagaaaggaaacttagagctaaggacatgagtttcataaattagaaacagcaaagaacaaaatacgcacagctaaaaattgagttgccaacacacagaacccttgagataattcagtcaagtgcttattgagcatcatctatatgcacctgacgctgttctggcacagggtta

SEQ ID NO: 389371 - DNA, 212 bp, Homo sapiens
acatcaaaataaaagtatgttttgctgccagacatcagattttagaagtgagtaagactttgaaaaaaattttctaaatcaaacctgtgtcctctcatgttactgaactttatggtagactctgtcaaacttggttgcatttgtttagaactagttggagatctttagacaaatatcagtaaagattgacaaaacttttgttcctgaagtta

SEQ ID NO: 389372 - DNA, 452 bp, Homo sapiens
aattttttactgaagaacaaagtgtaaagcaatttaagtggcaaagatctctgagtgctgtgtccagtagtggtggactaagggagtcaatgaccctggcaccaaaaacagatctggacaaaatgtatgaaataatgaaggatcacagtgatgagtcagagggcagagacccaggagaagggtagggatgtggcacttagggtcagtgttttccagaggtgtcagccggtcctgatcaggagcctcggagagctgttgggcagaggtccctggtatgcctcagagactcgagttaggacccagcaggctgcacccagaaagggttcagcagacagctgtcttcgtaggcacagagctggctcagtgccctgggttgggttcagggctgtcagggctgctggaatcctcagccgctagatggggcaaagtggatcttctctggaggaggtagc

SEQ ID NO: 389373 - DNA, 896 bp, Homo sapiens
agttactctgggggctgaggtgggaggctcacttgagcccaggaggtcaaggttgcagtgagctgtgattgtgtcagtgcactccagcctgggtgacagagcaagaccgggtctcaaaaaaataaaaaaacagataaaattgagatgtaattcacatattataaagttcaccattttaaagtgtacagttcatatgtttttagtattattcagtcatcatcattatctgattccagaacattttcatcaatccataaatatctcttgatttttatcttcgaatgataagttacttagcaaagtgttatttaatttgcaggtatttgggggtttcatagatatcttgttattgatttctaatttaatttcctatagtcagagaagacactttgtatgatttcagtccctttagatttgttgagatttattttgagatccagcctgtggtctatattgttgaatatatcacgtgcactgggaaggaatatgtattaagcagttgtttgaggtagtgttctgtagatattatttatatgaaggtggttgataatgttgttcagatcttttgtgttcatattgatttttgggggttctagttctctaaattcctaagagaggaatggtaagatctcctactatgattctgaaattgcctcttgctcctttaaattctatcaatttttgctttattttggtatgcattttgagtctctgttgttaagtgtattcacatttataataatattttctcatgaattgtcccttttatcattatgaactatctctctttatctattgtaatgccatgtgtcttaaaatctattttatctgatattaaaatagttactgtagcctgggcaacagagtgagaatttgtctcaaaaaataaaaaaaaa

SEQ ID NO: 389374 - DNA, 415 bp, Homo sapiens
ttcctttcctaacgtacagctttcatcacatcactggcgaaaaacatttgatgacttcccactacctagtcaatcaagttcaaacttcccagcttggaatagaaatgggtattcaaagccttccatgatttgattatatggtatgcagagattaggaaggcaggctttgaaattagactacctggactcaaatactttctgtatcaattgttagctctcttcttcattttatatgtaaaaagggattaaaaaccagtgcctacctcatcaggttgttgtaaggattaaataaaatgctacttatgaaatacttagcacattatcttgcaaatagtaagcatgcaaaaaatgtgagccattggccaggcatatggcttgtgcctataatcctagcaatttgggagaccaaggcagg

SEQ ID NO: 389375 - DNA, 303 bp, Homo sapiens
gtctacgactgagctacccaaaccacctccgcatgcccactccccaaggacagggcctgggtggggcacaaaaccctgtccagctcactactcccaggaggctcactatctagtacaccatcaccaaccctgtacttagaacctcaggccctgaaaggttaaggggacaactcagaatcagagctgcctggcaaatacagaacagccccaggagaaaaagtttgattgaaaaggtcagagatggcagcccagtaacccagccaatcagagggcaaatgaaagcaatatacctctggggtcatc

SEQ ID NO: 389376 - DNA, 236 bp, Homo sapiens
ataataactgatacaatgttggcactgctgaaattaggcaggtattatttgtgtaaagagttgtaacaaaaggacttgattaaagagcccaggctccaaactcatttgaaattccaggtaaagtataagaataataattcatatttgtatgggactttataatactctgaatgttttcatatacaagatctcctttgattcttataagaactcagggtaatagtagtacaggtttg

SEQ ID NO: 389377 - DNA, 725 bp, Homo sapiens
  misc_feature (23)..(23): n is a, c, g, or t
  misc_feature (42)..(42): n is a, c, g, or t
  misc_feature (291)..(291): n is a, c, g, or t
aattcccttgtgaaattccatgngattaatttaaaattcccngggatcctatctaacatcacagttgatggatataacaatgtattttgagaaatccagttttggtgaacagtaacagcattactgataataggcaacaaacactactgcattttatttctgataggcattataggtggtaatccaaatgattaatgattttattgctctttacattttctagaacaggtgatttgacataattgtacttttttctgagaagttggtagtgtacttactactctattttgnagttatacaataaatcttacttagctgacaactaggagtaaaagctctgacaaaaagcctctgctgtaactaaaatactgagatcattctatcttaacaaacttaacagatggggaaggggtatattttaaagatggagaaatgatgcagtttgcaaatatagtcaataaatattctcaagtgtacgtagctcaatttcatttgcagcaaagataacactgaaatgtctatggatgagattattggataaacttttttaaaaacactgttctcaagataggcaagtgattaagagcccggcctggacttaacttctgaagaactctttctgtttagattgcaggagcgttctctcggctcatctcttgttttctcacccagctgttcttcttctagttggccatcattcttcatccctccctccctttcctgca

SEQ ID NO: 389378 - DNA, 3164 bp, Homo sapiens
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagcggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagatttctttgctttcattaaaaatgggattcatttaaaaattaatctttccctgttaggctgatttcagattctctaggaaatctggtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaatt

SEQ ID NO: 389379 - DNA, 2287 bp, Homo sapiens
tgaaagaaactcatctccagatgagactttggacttgggactttcgagttaatgctttggaggactattgcgaaggcttgactgtattttgaaatttttcttaggcctttaccagacacagatgccagcgccatgcttcctgtacagcctgcaaaacggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagatttctttgctttcattaaaaatgggattcatttaaaaattaatctttccctgttaggctgatttcagattctctaggaaatctggtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaatt

SEQ ID NO: 389380 - DNA, 2224 bp, Homo sapiens
tgaaagaaactcatctccagatgagactttggacttgggactttcgagttaatgctttggaggactattgcgaaggcttgactgtattttgaaatgttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagatttctttgctttcattaaaaatgggattcatttaaaaattaatctttccctgttaggctgatttcagattctctaggaaatctggtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaatt

SEQ ID NO: 389381 - DNA, 2190 bp, Homo sapiens
catataattctctcttactctctacttatatctacttagcatatcatcgttataaatcttagttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagatttctttgctttcattaaaaatgggattcatttaaaaattaatctttccctgttaggctgatttcagattctctaggaaatctggtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaatt

SEQ ID NO: 389382 - DNA, 445 bp, Homo sapiens
gcattatgcttgtacagcttgcagaaccatgaggcaattaaacctcttttctttataaattacccagtctcagggattcctttatagcaatgtaagaacagcccaacacagcatgtaaaacattgattgtttttgctataactctttataaaataagaactattggtagtggtaataaaattgtttaatccattgcttcacattgaaggaatgtctaaatcagtgattcacaaggacaattgaatgaaaatcgtctctggctttttgaactttgcatatttcccagattttctaatatgcctctactcccaccagatttgagcgtaactgtagcagtgagttcaagttattaatgggtgtgtgttgcatccttcttgtatgtttgggggtggaggtggcatcgataaacgccgggtttcctctagggtcgggggcaggcatcaag

SEQ ID NO: 389383 - DNA, 672 bp, Homo sapiens
gcattatgcttgtacagcttgcagaaccatgaggcaattaaacctcttttctttataaattacccagtctcagggattcctttatagcaatgtaagaacagcccaacacagcatgtaaaacattgattgtttttgctataactctttataaaataagaactattggtagtggtaataaaattgtttaatccattgcttcacattgaaggaatgtctaaatcagtgattcacaaggacaattgaatgaaaatcgtctctggctttttgaactttgcatatttcccagattttctaatatgcctctactcccaccagatttgagcgtaactgtagcagtgagttcaagttattaatgggtgtgtgttgcatccttcttgtatgtttgggggtggaggtggcacatatagacataccagtagactaaatagtctaagatgtgcattgttgtttctaatctaatgaccattaggaataaataggtcataatcttttgtaagcatatctgtaagctttccttagggccaaccaaatatttctttgaaccattttccctgttctgttccacttgtttaggcctgtgctttatcatttacttgacatcttaatagtctagacagtatttgctttccttgtttatgactcttgtatgtgactctagagtttttcttttct

SEQ ID NO: 389384 - DNA, 412 bp, Homo sapiens
gaacacacaacttgtaagggaaaaatgcctaaagtgagcatgtgtacaacttcagtaaacacgctgtgcatgcggcccctcccaagtcctggcaggccactgtggatggccactatgcatgtggatggcgcaccctaagggaagaatcgggggagagggaaaacgacctctacccctgaagcatgccaacatataaaacccaagtcaaaggtcaaagagggcacttggccttcttccaagtgtactttacttcctttctttcctgctctgaaactttttaataaactttcactcttgttcaaatacttgcctcagtacaagcataagtacattctgccttatgcccctcagatgaattatttcctcggaggaggcaagagtcaaattgccgcagacctgtatggattcgctg

SEQ ID NO: 389385 - DNA, 197 bp, Homo sapiens
aagagacaaggcaagtaggagaaataattgcagtctagaagatcttaaggagacgtgaggactaaaagccatgttgtcctggatggggtcgtggaacagaaacaggatgttaagtacacaccagggaaatccgaataaagtgtggacttcagttaataatgatgtaaggaacattggctcctgatttatggcagatg

SEQ ID NO: 389386 - DNA, 683 bp, Homo sapiens
tctcttttcatggatatgtattttactgtgtcacatacaatgtaatctgattcagtgccatatgttgcacccagcattcagggatggggtgagacaaactgtctttccacatgtgttacacattaagaaggcaaaaacaaaagttataatcactgtgagcaaatagcactacctattgccttctgcaagaaattatttgctgttacatttcaacaagtaaaatgactaaaggtatttcaagattgacatttagcactgagttttaacatattttaatacacacaaattcaagaagatggtaaaaataaagcagagacttctaatatggtgttactgaaatccagcctataaaatttaaaagtatggtacccagatgtattaatattaacaaaaacagtatagtcatacctttcataattatctgtttggggtaataacatctaacagtggctggaactctatatgaaacacttgtgcatatgttacctcacttattccttgaaagttgttgaagtagatgttttattcccatataacagattttttttttttaaatgagtatttagaacttcagagttgtgtaagtagcagagctgggccttagatcctcataatcttatttcccaaattatatgttttccaccactgcaatttctgataaaaaggtaaatgcatcctagcac

SEQ ID NO: 389387 - DNA, 347 bp, Homo sapiens
tgaggcagggtcttgctctgtcacccaagctggagtgcagcagtgctatcatagctcactgcaaccttgaactcctggactcaagcgatcctcccaccttggcctcccaagtgctgggattacaggtgtgagccacggtgcccagccaacttgttaaagaatctgtattttatgataattgatctcacccttcataaacctttactagggagctataactgagagagctctagtctttattaaattcacctgtgtcggtaattaaacttcaagaaagtttaattttctttcctaggacaaagcaatacttttaaaaagggccaaagataggggaaagaagtgccatc

SEQ ID NO: 389388 - DNA, 375 bp, Homo sapiens
tcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatc

SEQ ID NO: 389389 - DNA, 441 bp, Homo sapiens
ggtgatggttgcacaatagcgtgaatgtgcttaatgccatcaaactgcacacttaaaagtggtaaattgtatgctctgtgccttgtgtcacaataaaaaatgctctagattccatttgctaatatgtaggacttgtgaaaaatatgcatatacaatatatattatggcaccactggactataattatttaaagacaaagtccataggtgtccccagtgagacgggactctgctgccaagcctccggcgggtcatgcaaacagtggagggcgccgttcctggaacagcagtgccccagcagctttaagcagtaggagggataaaagcaggagtggttaaagtgaaatggcagagctcattaatcaaattcgttcagttttattgattgattgagatggagtctcgctctgtcgccgaggctggagtgtactggtgtgatctc

SEQ ID NO: 389390 - DNA, 621 bp, Homo sapiens
tcaacgaataatattcagtaggtgctgtaagaaatagaattcatgacatacctgaataaagtgagagagaatttaccacagtccagaaacctgccatcaccttgtaataattataaatgagccatgatataataggccggattctatgaacagacatagtgaagagactaaagcaacctttatcttcctagttttctttgctacataaaatttacattttacttgtagactctgtgctcgtctttgagtgtgaggcttacccaagcagatttaaaaattgtgctggctttcttcactatccatcaaaactctgtcagttgatatggtcaataggaagtgcaaaaataatcctaaatttgcagcacaatattgcacaaaatatggtacatttcaaaaacagttttgtgcttaacttttagattatcagatcaggctacctgtgtctgtgttttcattggcttagacaatcaaggggagagctcatagctgaagcattttgtcatttagctgatttgaaatacttgcacagtgacatagtgacataaaaacaataataaataaatgagtggtcaaaatgatttctgttcttttaaactatttttactttttgtctgggttctt

SEQ ID NO: 389391 - DNA, 912 bp, Homo sapiens
ccccgtatcacaccctaatttggaatctagcgtctccatcagcacacccctctgagagcatcccttccctggcctcctgccttcactcctgctctatactcatgcctcctcctagtcaggtttatggtagaccccttgtaactcctcctccttcaaaactacttcaagccctttttgggtctttgaccgctttgcttttttagggcatgcccgtctctgctgcctcttctactctatcctcctgtgatcccacacttgactttgtcctagtctttccctcccctaggctgcttttcctttcttctgttttttaaggcgccttctgctgctgcagcccaccctctctcccctgctgcagtccctcccccttcatacgcctcccccaccacatccctccatgctcttgcgggatgctgccttgtcttgcaatctctgtgcacaccgcctccattaccctaatctaggtgttacatttgcctttttgtacttcgtattgaaattcggatagtgattgccggttgacttgcaggtggtgtgtgctcgcgttgtctccgttctcctcagcagtcttcagtgctgtgtttctgcttactgaatctatgttgtgcattccttttttacacttttactctctccctccatatttcgatttgcccacttgaaatcgttctcattttttataaattttaattgtaatttccgcaaccttctgttgcctcttgtaaaacagtaggtttgcaaaagggatagttttttgaaaatctgccttatagagaaatccattccttcttactcatctcgtgccatctacccttatccttgacattcttaactccatggtgtccactcattctgtttcctcacctcttccacctcaagaaatggttggttttaacctgggagagttgattg

SEQ ID NO: 389392 - DNA, 550 bp, Homo sapiens
tggcctggttggagctgctgttaaaccagggttgccatatgggccccacaggctccagattgctgccagggagcaactgccagccagcaagcaggcccagggtgcagcacaggcagaatgaggccagggcctgagaggtctcctgggtggaggtaaggcaggatgccagtgttttcccttggcacccatgcagtgggtaagcagatggaggcacccttaagggcagaatggggcctagaaactgccctcgttactttcagtgaaaggttttgtccttggaacttgagaacgctctcttactctttgttctagaggaacattcagaaggcctgggtggatgcccctcttgccaaaatcagaggtaggaagctcgtaggacaaaggcagcggagggcagaagatagctcctggggaccggagacaggcccagaggtgctcactgagtgctgcttcctctccccgatgccagcctcaagcagggccgtgggtacaaggaggagcaaatctgcaccaggctttctgccttacccaggaaggaaaagtgcttggt

SEQ ID NO: 389393 - DNA, 884 bp, Homo sapiens
agccagagacagctgggccactggcagtgagggagagtgaggatggcagagaccagtgccttgcccaccggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgccaaaatgctgccatcggtctcatcattttgagtggcgataggttagccctcttgtccacttggcctcagagcacttctcccactccttacatcccagcccctgcccctaatgctcccttggaccatcttatacacacacacacacacacacacacacacacacacacacacacacaccaccttctcagatagcaacaggcttctctgcctcaatatagaacagttaatccctgtgccagaggccttagatcaaagccctttctatactgagagcatggcagagcagtgtgaaggcaggcaaaggggaatgaggaggtctgaattcatctactccatccctgggtggttgtaggcatgtcaccttggccatctgtttctaaagctgaaagtctgaggcagcacaatggtccaggtagatattaattattgtgcccacagagaattgtttgaacctggaaggcagaggttgcagtgagctgagatggcaccactgcactccagcctgggcaacagaatgagactccgcctcaat

SEQ ID NO: 389394 - DNA, 2126 bp, Homo sapiens
  misc_feature (1754)..(1754): n is a, c, g, or t
agccagagacagctgggccactggcagtgagggagagtgaggatggcagagaccagtgccttgcccaccggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcggtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagagctgtgataagcatacaagtgcaggtttctttttgatatactgatttcttttcctttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaattttttgactttttaataatagccattctcanttgtgtgagataaggtctcattgtggttttaatttccatttctctgatgacttttgatgttaagcattttttcatatgcttcttagccacgtgtatgtattctttttgaaaaaatgtttattcatgtcttttgcccactttttaatggcattatttggattttttttgttgagttatttgagtttcttatatattctggataatagtctggataatatattctggataatatataatagtcttatatattctggatatattctggatacatggtttgcaaatattttctccggttctgcacgttgttcattctgttgatggtttattttgctgtgcagaaacttttttagtttaattaagtcccatttgtct

SEQ ID NO: 389395 - DNA, 744 bp, Homo sapiens
aggatggcagagaccagtgccttgcccaccggcttcggggagctcgaggtgctggctgtggggatggtgctactggtggaaggtgagccaggcagaacctggggtgcagcgggggcccagtgggttctgaggacccaggccaccagtgtggagctggcaaggagaggagaggtccccaaacccagctgggtgtccggtcccattggctgccttcccctctgtgcccggactcggggggtgttctgacaattgaacctgtgaggtgcagcacactgcccgctgggagcagagaggaagccaggcaagggtcagggagggagggactttgaaaggggacatctgcccaggagatgatcaagagccaggctttaggacttttcatgtccctccagccgggagaaaatttaatccactccttggaaatcctgctgagaatcccacataagatcagtcccccaaaaggctctggggacagacagctctgcctcctgctcttgtgtggctggaaccaagtcccttcagctctctgccctcaatgccttgacattccgaatgggtggttgtaaagattaaatgggataatgggtataaagtgctagcctaaatagactctagggtatttaagttcattcactcccatcctctccagccccaccactattttcactgtgtctactcctatgagcccaagcacttcacctctggaggcaacctgggtctgcgaggtacctacctcaacctaga

SEQ ID NO: 389396 - DNA, 2240 bp, Homo sapiens
  misc_feature (1868)..(1868): n is a, c, g, or t
agccagagacagctgggccactggcagtgagggagagtgaggatggcagagaccagtgccttgcccaccggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcggtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagagctgtgataagcatacaagtgcaggtttctttttgatatactgatttcttttcctttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaattttttgactttttaataatagccattctcanttgtgtgagataaggtctcattgtggttttaatttccatttctctgatgacttttgatgttaagcattttttcatatgcttcttagccacgtgtatgtattctttttgaaaaaatgtttattcatgtcttttgcccactttttaatggcattatttggattttttttgttgagttatttgagtttcttatatattctggataatagtctggataatatattctggataatatataatagtcttatatattctggatatattctggatacatggtttgcaaatattttctccggttctgcacgttgttcattctgttgatggtttattttgctgtgcagaaacttttttagtttaattaagtcccatttgtct

SEQ ID NO: 389397 - DNA, 718 bp, Homo sapiens
agccagagacagctgggccactggcagtgagggagagtgaggatggcagagaccagtgccttgcccaccggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccggtaccagccccctccccagtccacaggctctggggtcctgcctggggcctgacccctgggccctgggcagccaggccaagggcatttttactacttacagaaaattggccaagggcagagggtgggcaggctaaaatgggctgaattccagattgattctgaagaacgacagctgatttctggaagacaggggttgctgaaacctgatgaaagagatggtaggctgtagagatcaatggtgtgggttctgtaaccaagcaacctaggtttgcattctggcttcagcatttctagttctgggcttcttccataaatcggatattatttcctaactcatataggtggttggaagtatttacttctattatgtgtaaataacttaaaataatgcttgatacctaggactctacgtaagtgtttgtgaacacaaatgggggcgttatcaccactactgcacccgtatgtatctgggctcctggagtggagggac

SEQ ID NO: 389398 - DNA, 870 bp, Homo sapiens
agccagagacagctgggccactggcagtgagggagagtgaggatggcagagaccagtgccttgcccaccggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtacagatacttctagtacctaaaactagacccctctccatctttgttctctgtctcatctcatctcactttctggatttatga

SEQ ID NO: 389399 - DNA, 649 bp, Homo sapiens
ttgaagtgaagtcagtaattcaggggtgttggacaccagccaagattgtttatacaccccttggagagaccgtccatagtttggcttgatgcatgacatgggggaagcgggtatcagaggtaggggattcctaactgtccagctttaaatctcagctccatcacctacaggctgggtggctttaagcaacagcctattctatcttcctaagcttcagtctccccacctatgaagggggagggtgataacattacctcctcacaggacccatgaattaatatatatccaaagctcttggaacagataataagcacttaataaatgtttcttgtttttgtagttattgatgatattattccaaaattcccaggaggacggttataaaatgttctcatctgccaggcacagtggctaacgcctgtaatcccaacactctgagaggccgaggcaggtgggtcacctgaggttaggagttcaagaccagcctgaccaacatggagaaagctcatctctactaaaaatacaaaaattagccgggtgtggtggtgcatgtctgtaatcccagctactcgtgaggctaaggcaggagaattgcttgaacctgggaggcagagattgcagtgagccaagatcgccccattgcactcca

SEQ ID NO: 389400 - DNA, 755 bp, Homo sapiens
tacccacgactccttctccttttagtgtggcgtttgcccgctagacccagcccagagtccaggtcagcacaggccctctcagccaaccactcatgacaaatgaggagtcgagatccacagtgtggatggggcaagccccagttcacagtagagaggtggagcttagtacttcctgctgcccattagacaccctttcttcctaagttcaagggaagcccacacatgtactgctccctgcatcctgctctaacttcctctcatcctctggatctcagctcaaatattccttatgcagagatgccttcccctgattccctaaactagactcggacccctctgttctgcatctctgtggcatatcatctgccccttttgtaaaacttataaacttgtggttacttgtttagcgtctctttcctccccagaccataagcaacataaagacaaagggtacatctagcacatagttcgtgttcaataaatgtttgttttcatcatgccacgggaagtgagatataccaagtattcaaaaaagtgttcaaatcattactaacagtgcttgctctgtgctggctgagtccagctgggcccagaattccacggttctaaatggcgcatattccatgtgcataggctgattgaaaatgtattaaacctaaatttttaaaaaaaagcacatgatactacacatgtcatgatgaatgaatagacagaactcctcctgaatataattacaaagttctgatccatctcag

SEQ ID NO: 389401 - DNA, 2390 bp, Homo sapiens
ggcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggaggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatatgtgtgtgtgtgtgtgtatacatatatccacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcgatttataaagtataataaagatgactgtaagac

SEQ ID NO: 389402 - DNA, 2139 bp, Homo sapiens
  misc_feature (1046)..(1046): n is a, c, g, or t
ggcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcactcaagaaatgaagtcatnggccgggtgcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggaggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatatgtgtgtgtgtgtgtgtatacatatatccacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcgatttataaagtataataaagatgactgtaagac

SEQ ID NO: 389403 - DNA, 1583 bp, Homo sapiens
  misc_feature (1476)..(1476): n is a, c, g, or t
ggcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgtcgcctggactagagtgcagttgtgcattcttggctcactgcaacctccacctcctgggtttaagtgattctcatgcctcaggctcccaagtagctgggattgaaggcatgtgccaccacgcccagctaatttttgtattttttgtagagacaaggtttcaccatgatggccaggctggtctcaaattcccagcttcaagtgatccaccacctcagcttcccaaagtgctgggattacaggcatgatccaccacgcctggccagtaatttcttaatcctacctccctgcttctattgcctagcccgtacatttgaggcttccatggagctttctgtggtactgaaacacttggagtgaactgcaaacttggagtgaactacatccaacctttctaaggtggctggggaaaattcttgtacagcaagttgggacaaaatagccatatagaaacagccatataagatcccaatatagaaaaatcgggatattagaggaaatacatgatttccatttatggagtgctacatgtntgccaaaatgtatttctgcttttcatcttcttgacatctgaatattaaagcaggtgttgatcatttcatattataacttggacgtttctttcacaacaaaaaaacaa

SEQ ID NO: 389404 - DNA, 1402 bp, Homo sapiens
  misc_feature (309)..(309): n is a, c, g, or t
aggtgatctagaggatcccgtatatgggtgagcctcccgtttatcagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcactcaagaaatgaagtcatnggccgggtgcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggaggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatatgtgtgtgtgtgtgtgtatacatatatccacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcgatttataaagtataataaagatgactgtaagac

SEQ ID NO: 389405 - DNA, 915 bp, Homo sapiens
gtttaaatggctcaaagaaaagactataaatggaattgaacatgtttgttagctgtttgagcattttatattggtaaattttttattttcttattttttgtcttacagtcgaccaggctggagtgcaatggcacgatctcggctcaccgcaacctccgcctcccgggtttaagcgattctcctgcctcagcctcccgagtagctgggattacaggcatgcgccaccacgcccggctaattttgtatttttagtaaagacggggtttctccatgttaatcaggctggtctcgaactctgacctcaggtgatctgcccgccccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatatgtgtgtgtgtgtgtgtatacatatatccacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcgatttataaagtataataaagatgactgtaagac

SEQ ID NO: 389406 - DNA, 1305 bp, Homo sapiens
ggcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccag

SEQ ID NO: 389407 - DNA, 1600 bp, Homo sapiens
ggcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgtcgcctggactagagtgcagttgtgcattcttggctcactgcaacctccacctcctgggtttaagtgattctcatgcctcaggctcccaagtagctgggattgaaggcatgtgccaccacgcccagctaatttttgtattttttgtagagacaaggtttcaccatgatggccaggctggtctcaaattcccagcttcaagtgatccaccacctcagcttcccaaagtgctgggattacaggcatgatccaccacgcctggtcccattgttctttacatctgatgggctgcttttgggttgttttatgcagtgcgagtgtgtgtgtaaatattaacatctatcttgttattcctttttatccttatccaaaaacctcagctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccag

SEQ ID NO: 389408 - DNA, 271 bp, Homo sapiens
tgctgtgggatttgaacaagtgcctttgtttttctggttctaagttcagcatctgtgcaaatgaaaacattggtctatgtaggtggctttcaaactgtaacgcatctcagaatcacttgggttgactgctcagttggcagattgctaggccccttcctcaggttgctagttcactggaattagagacccaatatctgtattcttagtaagacctgccaggtggttctaaaggacaaaatctataagtgacattttgaaaaacactaatcta

SEQ ID NO: 389409 - DNA, 389 bp, Homo sapiens
tgcaacctctgcctcccaagttcgagctattctgctgcctcagtctcccgagtagttggggtctacaggcacacgccaccatgcttggctatgttttgtatttttagtagagacggggtttcgccatgttggccaggctggtcttgaactcccgacctcaagtaatccatccaccttggcctcccaaagtgctgggattacaggcgtgagccactgtgcccagccaaagagtagagttaaaatgttttcttcaatggctgtttcgagctgtgttaaaaaaaaaattattttaaaaatgttttcaccaccaaaataggtatgtgatgtgactgatttcttaattatcttgattgaagccctccacaggtaaacaccaaaacatcacacac

SEQ ID NO: 389410 - DNA, 317 bp, Homo sapiens
atttttagctgacagcataagggattcctgacaggccatgttatccaattttacaccaaaagaatgaattctctttcagataatatttctctacaaatacaagtggaatatataacccaatttagagctgactttgacaatacaatatatttatatgtaaataatatcctatatatttgttattatttatattattagtttatgttatgtatagttgtaaatatacacgtctacatgtataaatacataaataaaatgtatctgtaaaactaaaagtttcagttgaattttggttctccatggaatataagatattt

SEQ ID NO: 389411 - DNA, 406 bp, Homo sapiens
gggtttatttaaaacacacacacacacacacacacacacacacacacacacatacacacacaaaacaaaatccctcataaagatccttgaacatcagatgactcttacaaaacaatttgatgaattaagtgtaaatgaatcaggaacatgtggattaaatttccctcaaaatacacttgggtttaaatattcagagagaaagtgcttgggaaatatattctggattttcctgagctcaaatgttcgaaaattcatctcaaactttacttgacagcttccccaccccaggtcagatcgcattataaatacatggatatacgtctattgcatggtcgtaggggcgcacacatttttgcggcctggagtaataactatggtatatggagtgtgctgtgaagaagggctg

SEQ ID NO: 389412 - DNA, 759 bp, Homo sapiens
ccctgattcttccttttttggtttagtctaatggatgaaaaactcaaactgactgatgtggctgtaatcttgggcctgtgaggtagaacagcagaaaaaaaataggaatttagaagaagaagacttggtttgaatttatctcctttaataggtgtgtggcggctgggcacggtggctcacgcctgtgatcccagcactttgagaggctgaggcgggcggatcatgaggtcaggagactgagaccatcctggctgacgtggtgaaaccccgtctccactaaaaatacaaaaaattagccaggcatggtggcatgcgcctgtagtcccagctaatcaggaggctgaggctggagaatcgcttgaacccaggaggtggaggttattgtgagccgagatcgcaccactgcactccagcctgggcgacagagtgagacttcgtctcaaaaaaaaaaaaaaaaaaaggaatgtgtcagccaggtgtggtggctcacacctgtaatcccaacactttgggatgctgaggtgggtggattgcttgagcccagtagttcaagaccagcgtgggcaaaaatgataaaactctgtctctacaaaaaatacaaaaaatttacccagatgtggtggtgcatgcctgtagtctcagttatttaggaggctcaggtgggagaatcatttgagcctgggaggtcgaggctgcagtgagccaagactgcgccactgcactctagcctgggcaacagagtgagactccgtctcaaaa

SEQ ID NO: 389413 - DNA, 4404 bp, Homo sapiens
aagtgtcggtgaccaggggagtggctcagaacaacaaagggtcatgaccagagctagcctgacctggacatcacataccagtgttagtggcctgacatcaagtcagttacctttctgagcgtggttccataactcactgctggggtcagaactgctctgtgggcccaagcctgtgggagctgaagaagttagacacaggggtgggcacaggggtgggaggtgagggcagagaggggcagcgcctcacctccagtcctctggagtcccagcctggatgatctctaagtgacctcgtttgttttttgtttgttctgtctgggttgtttttttttttttttctcacagtgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacgtgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctatgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaattatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttcttaaaatacagcctgggtacccagtgaaagagctgaaatgga

SEQ ID NO: 389414 - DNA, 251 bp, Homo sapiens
gtgctcgcagacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctcttcgcgtctgtggccctggtggctgccatcatctttggcgtttgctatagg

SEQ ID NO: 389415 - DNA, 4524 bp, Homo sapiens
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacgtgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctatgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaattatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttcttaaaatacagcctgggtacccagtgaaagagctgaaatgga

SEQ ID NO: 389416 - DNA, 4432 bp, Homo sapiens
ccccaagttgttctgccagaagtgtggctgagtatttctgcagccccagtgaaagccacagtccacggggcccgcactctctcatcattctggggaggggaaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacgtgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctatgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaattatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttcttaaaatacagcctgggtacccagtgaaagagctgaaatgga

SEQ ID NO: 389417 - DNA, 272 bp, Homo sapiens
ccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatact

SEQ ID NO: 389418 - DNA, 200 bp, Homo sapiens
gtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcgg

SEQ ID NO: 389419 - DNA, 503 bp, Homo sapiens
ttagcccttcagggtaggggatggacagggaatgggatagaaatgggggattaggtaggcaagtgtgtactacaattaaggagaatccttgagctagaactgttatccaaagtgtaatcgagaaccacatgtggctatttaaatttattaaaattaaatttaaaattcaattcctcagtcataatagccatgtttccagcgcttaataaccacatgtggctggtgactatcatgtcacagcacagatataaaacatttccatcactacagaaacttggacagaattttgtcacacatatttcttactttcatgcaatgtgagacacttctgtgacagatccgaagttgtatttttctttaatgaacacccatttggctaacaaaactacagtttcactcaggatgcctgtgttttgttgttattgtttgatacagggtcttactctgtcacccaggctggagtgcagtggtgtgatcaccgctcactgcagcctccacctccc

SEQ ID NO: 389420 - DNA, 556 bp, Homo sapiens
cccgcgctgtgaggccttgacctgccgtacgtagaggcgccaggccaggccgtgggccaccagcagttgtgcgccgccccgtaggtgccgccgccagagcggttgtagatgtcacttagccgttaggctcgttgatggtgatccagagcttcaccaggtccccccagctcctggaagcacagcccagcgtaggcctggaagcctcggccgtcgatgggttcagccacccgtcggcatgcaacagaggctcggggaggcctagagacaggattttgccacgttggccaggctggtcctgacaggccagacaggtcctgacctcaagtgatacgcccgcctcggcctcccaaagtgctaggattacaggtgtgagccatcgagcctggccagcatcagattacttcttaattaaaaatggaaaagttaccatatggcacatatcacctttttttttcttttttcttttttttggggggagtagggaggagggacagggtcttgccctgtcgcccacactagactgcatcctcgaccacctgggctcaagtgatctacc

SEQ ID NO: 389421 - DNA, 596 bp, Homo sapiens
ttccaatttaaaaaagggggtgttgtgttgcaggaaaggatttgtatgagaaagaagtgaggttgtccttgatcccttgaatttatttgctcgccaatgagggctggagtgttttctgtctttgttactgtctgcactttcaaggaaaagaaagtcttctcatcagtgatatcagagtgtaccaagaaagatcaggttgctgattttcagaatgatccaggtcccagtaaataccaatgatttttatcagattaagaagtcaggcagtctactaatatccttgtcagaatcaaatctaattccaaggttgcaaatagagctataagaaagaaaaaaaagagagatgtaatattgtggctggtaatttttgtccttttcactgtggacgtgaatattttgtttaaatatttagttgggcaacagcagcttcagagaattctgtgagatgggatttgtctctagaggccccttcagtattagctggctccctacttgctggttgggcagtgtcttcctgctcctgtccagggatcctcccattcccttcttgtaagtctgtcttctgaaaaacaactccatatctgatttccaccatc

SEQ ID NO: 389422 - DNA, 640 bp, Homo sapiens
tgtcttaaaaagtttaaagacaacagacataaatctgtaggactagatggggaagagatctgaggatcagagccagagtacattcagaatcactcctttgctaagatgtggaaatttcatatctaagtctccattgctgagtcttgccttaggatgaattctcttcccgaaagaaattcagttctttatgcagttagagttctgagaattctgccctgaacatgtctggattcccacataggcttcagccgggactcttgctattcaccattgcggtccagaagaagctaagttcagggatcctgggcattgaagataatacccatgctgtgggctgagaaattggtcttgactgcctgctgtctgggggaagacaccatgtagatgaggcaaactggttcttctgtaaatctctttgtacttggcttgcactgctggaatcaacctgaggaattaggattccatgactcttgtttcccccttagcaaacacatgttttgcattcttatcatgtccagccatcttctgttctacctttatgatttcttacctggaagtacaacatgcaggaaaatcaaatattcctaagtacagttggaatgtcccttgggaagctgcaggagtccaaggagatgtcata

SEQ ID NO: 389423 - DNA, 584 bp, Homo sapiens
tggggcagggcagggggagtatatgggagctctgtactttctgctccatttttctgtaaacctaaaactgctcttaaaaataaagtctattaattaaaaaaaaaaacaaggcaagatcaaagcatgactacagctagcatctctgctcactgagtccaatgttttcagggtgtgcctattttgggttttcagtttattagcatggcttatccgataatagatacgagtacttcatgtagtgtttagttaaattttgcaaaactgcattctgaggaagtcctgttctttcatttttaaagctacaggaagagagggggaagggacagaagggaaggaggaggaaaagaaggggggagcatgagggaatcaaatgccacagtcccatatttaacatttgcccttacaggaatagcaaatgtgcggcacgttgatttctcactatcagcaccaaagttttgtactctagatactgcaaataaggaatgtcagttaattggagttaagcaacacaggaacagagggttatatcttacttctctctgtgatcaaccctctttcccttttttgccccttctcacatagac

SEQ ID NO: 389424 - DNA, 802 bp, Homo sapiens
agcgcgttctcgtgtcccggccctgccttggcctctagtaaatggcggaggtggttttaatttttttgagggctgaggagatcacttccgaaggcggtaactgcagcctccctgcccctccaaggtggtgctggaaggacctccagtctttcctcgcctcatcccactccacggcgggactttgacagggttacctctcgaccctcatcccactccacggcgggactttgacagggtcgtgcagttaaccccgggggcgcaaagaggggagtcattcctttcgtgcatcctgacacacacaggttcttcccggagacgaatggtgccagtgatggttgcccgctcggatgcgtagtttccagtttacatttagaaccgacctgccagactccctcctctactctccccaccaccacgacccgcctgccccgttccccaagcctgagaagttgctggctacgtgtttctataaagaatgagtgaaaattctgccttttggggaagctaccgcagctggggtacccacaagtaatgttttagatgtattgatggccctgcccaagaatgaagacctcaagttagactccttggctgccttgtttccttgaattagcacagggaagttggacccaacactcttaagagtgaactcagctctgggagcagtgtttaacccggatatttatttgatcatttataacacgaggagacctagcaacatttcagaactgaagggatcagtgtaacagacaaagcaactctgtcacaaaaggaagccttcatctttttaaagtgggggtga

SEQ ID NO: 389425 - DNA, 685 bp, Homo sapiens
gcagtctgtagctcctggaagcccgttttgtccatgatttagcaggaatgcattacccttccatgaggaggagaccccattctataccaacacctattctgatttttcggtcaccctgaagtttatattcttatccaaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgaaccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaacaaacctacgccaaaatccatttcactatcatattcatcggcgtaaatctaactttcttccacaacatttctc

SEQ ID NO: 389426 - DNA, 560 bp, Homo sapiens
tactccaatatctgtagctttcaactgatgtctatttttggcttaagcctctctgtaaccaattatataattttacggtaaactgattttgtgatgtacaaagttcaaatgattcaagtataaattattaccaagcaatttattatgtcactcaataaaccaaaagcatgcacaggaatagatctcccagcataaaggatgtatttaatttatttgcatgtgtaactttttaaaaataaagaattgtggtataattttaaaaaaatagtagatttatgtcaccataaattgatgatttctattaaaagtaatggcaaaaaccgatatcattatttttgcactgacctaaataaaatcaactgggctttctctgctgcccagcaatctttcttaatttgttgtctgctctttccattttctacgactgcttaaaaagcgtaaaccgtctcctatctctctctctttctctctctgtctctcgctttttaagagataggttatcattctgtgacccaggctggaatgcaatggctagatcatagttcactgtaacctcaaac

SEQ ID NO: 389427 - DNA, 1620 bp, Homo sapiens
ctcgcttcctgtgagtcttcaggtcgccgcttgctctcgttcctagggtttggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaaggtacagtaaattaatcttggttttcaagagtattggttaatgcacatgagcaaaagatttactaaagatgtttattcttcagttgattctcttgccataatctattgagaaatgctttatttgcatttctcgttaaagacttaacattaaagacttaactttagggtgatttacttttttcttttcatcacatagtgtttattaggactgggcaacatagtgagactctgtttctatgaaaaattaaa

SEQ ID NO: 389428 - DNA, 1555 bp, Homo sapiens
ctcgcttcctgtgagtcttcaggtcgccgcttgctctcgttcctagggtttggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaacttgatgcagttgaatacaacaatggctgtaggtatgctgcagaaatatcattcaagtgaaacagaagggctttcctggccagacacagtggccactc

SEQ ID NO: 389429 - DNA, 785 bp, Homo sapiens
ttcgacgggtctggcggctgttccgtgagggttcaccctgcctgggacgtacagtccgcatcctgtgttctcagccacttgagatcatttatggttttgcaattcaacctgaaaaatgaaatcaaagcttttatcaaaacaaagcatgtttagtgctctctgtctcactgtcttttagatgccaaaccttagattttataatgactcctcaaccgtttagatcttggttatctcagagggatcatcagctttttaagaaagttttgagagaaaagcaagtgaagaaaagcatagtcaatgctcaacatcacgggtctctcactgaacacaccacgcctggtattctctcacagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaaggtacagtaaattaatcttggttttcaagagtattggttaatgcacatgagcaaaagatttactaaagatgtttattcttcagttgattctcttgccataatctattgagaaatgctttatttgcatttctcgttaaagacttaacattaaagacttaactttagggtgatttacttttttcttttcatcacatagtgtttattaggactgggcaacatagtgagactctgtttctatgaaaaattaaa

SEQ ID NO: 389430 - DNA, 313 bp, Homo sapiens
gggagccggggggcagaggctgcggagccccaggagggtaagtctgggattttcgggcccagagcgagaagggcctgggtgaagtcaccgtgtgttggggacctttgagtgtggggcagggggagggtcccgatcgcttgcaggagagacgtgtgtttgggttcgagggcagggtccggctgcacggaacaggcgctgcatgggaagatctgggaggacgaggcttacgggggcgtggagggtgtcaccaccctcagctgcggacgtcgtctccactccccgctaacccctaacagcccttcctcctcctctc

SEQ ID NO: 389431 - DNA, 290 bp, Homo sapiens
tactttggagattctgaagccaagcagcttgcccaagtccttcttcttttcccattaacagggtatgattatcaccaagccaaacatcatcatggagtggaggtgaaggaagtggagcagggagaggagccgtggataatggaaggtgaatttccatgtcaacatagtccaggtaagttagtagattatcacatgttaaaaaacactcatcccagacctttgggagtgactaaagagttgtttatatgtactcggtaccctcagtaacacctcccaacccccaaatatca

SEQ ID NO: 389432 - DNA, 1492 bp, Homo sapiens
ctcgcttcctgtgagtcttcaggtcgccgcttgctctcgttcctagggtttggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagtcaattaaacctcttttcttcataaatt

SEQ ID NO: 389433 - DNA, 1719 bp, Homo sapiens
ctcgcttcctgtgagtcttcaggtcgccgcttgctctcgttcctagggtttggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggtggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaatctctttcagctctgaaacatcacacatgtaagattcaagagtttgccgacctaactgaagttgaaactttcggttttcagggggaagctctgagctcactgtgtgcactgagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagtcaattaaacctcttttcttcataaattacccagtttctcatagttctttatagcagtgtgaaaacagactaatggcccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatctcctgcgttttcagt

SEQ ID NO: 389434 - DNA, 558 bp, Homo sapiens
aaaaaaagaagtatgactaaatatatgttttcaacataaatatgaatggactaaactattataatttttaagggagggtttcagattgagtcaaaaaatgaaatccattgtctgctgtacaaaagatacatatcaaatagcagaaatgtaaatgataaaggagtgaatgtgcaaagaaacaattaagcaaatgtaacggaaggaagaacaggacagggtcaaaggtttaggggcctagtttacacaaaaagcccaatccacagtgaagacatcacagtagaaaacttttttttgtgttgagtaacatactgtacactgcaaatagcaacaccgtatttgaatgtatttaaatatctgaagcaaaaacagctgggggaatcttagtctgttttttctgctaaacagattacctgagactgggtcatttataatgaacacagatttatttctctcacatctggaagctgggaagtccaagatcaaggcaccagcatttggtgaagccttctttctgtgtcatcccatggcagaagacagaagggcaagagagggtgagag

SEQ ID NO: 389435 - DNA, 360 bp, Homo sapiens
gatgcagagaagggtacatttgttctgtggcattttcagttgtaaaatgagtaaatcataagtttcattataagcttggtcttgtgttcttccatttaaagtgtggtgaatcagatattgccattagtgaattaagaggagaatatttgaaggacaaattaatctcagttggagactattccttaaaatgttcattagtgtgctagaaagatttgggagaaggtataatcactacctcccgcttcccagcatacaattgaaattaaactcctgtggataagtcactcaaaacagctgggctctgcctaggagtatctcaaaagctgggccctagatccatgtaaaatacaaggtgtttaa

SEQ ID NO: 389436 - DNA, 548 bp, Homo sapiens
ggcctcattagaccacgggttgcagccggagcggctgggaggttcgcgcgtttctcagggttcggtcggaggcggggaggccggagctgcgggcgtagggacctggcggctcctgaagcgcacgcgggcgggcggcaggtgtgcgcggcatccctgtcacgtggccgaagagcctggggcgcgcggaccctggcagggggcggggcgcacgcaggccacacccacttcaggctcccacccggtcgctggagaggggccaaggcctctggaaggtccaacctggagggtggttcaaaggggtgttgggcaccctcaaattaggggaaaattggggagtacgctctccttccccagggtggaggttactacaatcataagcggggagccggtgcccctgaggaaggagaccctgagggagataagatggaggggctcgggattccggggagccccaagtcccagcttgaaacggtggagtccgggcaaatgagctctgaggacggcttctgggcctggccgtgacccagattgcagtgagagttcccgca

SEQ ID NO: 389437 - DNA, 390 bp, Homo sapiens
gtcactagccagaattgttatgtatgatagaattgcctgggacttcttcatgggccagacagattacaaggtagattctgtgtaattgccaatgcatcttcctatacctggattaatgctttagtttaagtggaaaggtcaacacagaaacatgaggaggaagccagttgaatttctaaggtagactttgatggtttatgggatttgtttagctgattttgtccaagaccctagaggacctagtggaagtcagtactgtagattgacctcaccttgctgctcagagttcctgtttgtagtagccttaattacataattcataaggcaaattaaatacatttggtcctccctttgttggtcagattaatcagcttggttgatagaatggca

SEQ ID NO: 389438 - DNA, 709 bp, Homo sapiens
tagattttcatgttgcttcacatttattaaccttcacccattaggctgttgttggggtcatttgtatgatcttcaaatattcaggccttctgtagaagccttctaactcgagcggaaatggatggctttctcctagagggaaattaaggggtccaaagatacttaacagtgcatacagtaaagagagaaaaaacaggaaaaagtcgaggattggaatctccagcttatagagctccattctgctccagaacaaactctgttttattcagttacttagttacacagcacatcagagagactaaactattgacccttgaggtacagaaaagaagtgagccaaagactttacgagattatttcctagcagaaaattaaaataaaatctcactgatttctccatctcttccatcataaggtgaacagtaagtaaaggaagtggagagtttaagggacagcgttaggaaaaacttctgagctcctacatgtgacctggataatcataactttaaccctcaactgcctttccaccacctatgatgttggggtttcagaaaaggtggaattggaggaggatggattttcttgtcaagatcttgggcaaatgatatgctgaaagaaccacagctggagtccaggggttacatagaagtcactggtattacaggatatttggaggtcaaaactttaaagtattatccataatacttga

SEQ ID NO: 389439 - DNA, 127 bp, Homo sapiens
ggaccgcggttactgaagtggggtggagaactgacttcagctgctctagttttccagtcttctcctcgatctcaccacctggttctttctccagttcagccaacaacagccttgtgatatccagcac

SEQ ID NO: 389440 - DNA, 446 bp, Homo sapiens
  misc_feature (94)..(94): n is a, c, g, or t
gttcacaatatctatggagtgagtaatttgttgagtgggcctgggctcagaaggtaggactacatgcagtatagtacagttgtgcagtgcaatncctgaacagtcatacatgataactctggcatagtaagaaagaatgtgggaaaagaaaatagtagctgggctataaagtgctttgcgagccaggttacttgttcttatggagggatgagggtagaagtaaaagagaaggtatcagaattgctgtcaaattttccacattatgtatgcttctgaccacgatggggatgctgatgtcctccccttacccctactactttcccaggatcttcgccacattgccaatttactgtaagtcatatttctcaggtgagctgtagctaaggaatgtctgaggaaacactaggacaatgggagagccctcacaggttttttaagaaggcggt

SEQ ID NO: 389441 - DNA, 449 bp, Homo sapiens
tgggggtgggaggtgggagaggagtgagggaagggaattcccaagtgttggtattgctcaagctccccaggtgattcaatgcgtttcctaactttgtgcatcaaaatcacttaggatatcttattaaaatgcggattttgatttaataagcctgaagtgggagctgagattctgcatttttaaaaagttcccaggtgatgcccatggtagtggtgggggccaggctctgagtagcgattcatggcatttacagtatttttactagagaacgaggagaattcaatggagtcaatgagttttcactacagacatttatcttcaagatccttaaagctgcacgttgtgttaaaagatgcccaagctctcaacgccacatgctaagtggccatcctgagaaataataacctagagcttgactttattttttatttttttgggacagagtctca

SEQ ID NO: 389442 - DNA, 226 bp, Homo sapiens
ttcatttggaaatttctctgcagtctctcaataatttacacatggagataattgaatatatgacatgttttgaagggtaacttctaattgagtagatacatatctccttttttgaaaccctttcttctctaagccatcacattttcctccagattttatctgattttcctctggcttcccttttcagacctttgcttgttctggaaagggaaaccagtgaggtagg

SEQ ID NO: 389443 - DNA, 783 bp, Homo sapiens
agggagaacttactgtggttgtgagctggacaccacagccctgaagcctgagcaggagcagtgaaaggagggggtttaccatatcatcgcaagctgagaggaaggctgttgggggatacatgcagctggaggaagaatgcttagggcatacgtgtagcttgtttgttctttacaaagcatttgggagatttgccctgagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagattggtggaaatcaacaagctgaaaaaactaaagttcaacatatttaaacacttgggaagcaggacctgctcagatccagcatggtgccagcacgttgtaggcctttgctaaaagcatggtgaatggatgaatgaataaactccagatgatggggagtcacagtccacttgcactccaaagtttgagaaagcactagtctacgctgtatttgcaggtcttgtggactccagcaagaattgtgtcactattggcttctaatgaaaagcactggatgccg

SEQ ID NO: 389444 - DNA, 476 bp, Homo sapiens
tgtaattccagctacttgggaggctaaggcacaagaatcccttgaacccgggagtcagaggtttcagtgagccaagatcgtgccactgcactccagcctgggtgacagagtgagactctgactcaaaagaaaaaaaaaatgttttaaagctatgtcttaacagataaatataggaagaacacaatggggtttgtgatcttgaaaacttgaatggatccaagaaagtgtttaaattttaatttggctcagatatgtaggactgagaaccataaactctcccacctaaaagacaccccccacaccaccacccctgtccggtgtcaggacttagccatattatttggtacagtgggcctatagtagtctttgacacattgatcaatgtcacctctaagctttttgggggtggcttatacctctttgaggtatcaatcttagcagtgaaataaagagggtggcagtagtcattatagaag

SEQ ID NO: 389445 - DNA, 229 bp, Homo sapiens
agtgtgccatggtggcccattgtgtttcttgcctttctcctttcctagatcggtgaaccttccttccttcctgtctttacatgggcttttctttctgtctggagcaccatctcttttatgcatattctttacctgatgatattctcattttccaggtctggtgcagatgtcctttgtgaaaggtcctctgacccttccaggtagattttattttcttcttccctccctt

SEQ ID NO: 389446 - DNA, 785 bp, Homo sapiens
  misc_feature (1)..(1): n is a, c, g, or t
nctcaggcacacgttatagttgctgtaggttcagcagcgaagaagtacctgcactcatgaagcttagaatataaacttgtggattctcatgaagtcccttccccaccagagcggttaaagaattaccagccggcaagaatcagtgcataaagacagaatcccttatggtgaacatgtagaggagaataaagacggcacttggaaactcagtatgtgagaatctcagaacgtggctttattttggaagaaggttgttatagatgtagttagctaagatgagactatcgtggcaggacaaacatcacattgaacagagtcagagattaacataaacccagggatgctgaagaatgtcaccagcgaccagaagctcggagggaaggaaggagcagattctccccagtgcctgctacaggaaccagccctgccgacaccttgattttggattttcagcttccaaactaggactgagacagaacaaatttctgttgttttaagtggcctactttgtggtactttgttgcagctgccctagaaaacaaatacatgtgttgactgtagcttttactaagggaagatgacgtctttagggctctaaagatattcttcatcaagtttaggaaatatccctctattcctcttttacataaagtttatactatgtttgttaactagaatcacttctcagcaggtataattaatatgatcctactgttattttctcctttattaatattgtgacagattgcaagaacctcaataaaaacctctctttccttcctgta

SEQ ID NO: 389447 - DNA, 370 bp, Homo sapiens
agggaagattgaggtcaagagttagagaccagcctggccaacgtggtgaaaccctctctactaaaaatacaaaaattgatttggctgatctggctggctaaaccggtgtccccttactccctcaatgctccaagtgtgtccctcccgaccctcccgaagctgtgcagtgtgtcgaagaggacaaccatcaccaatagaggaccggtcttcctttaagggtatatgtgtagctgggtttccattaaaacctccaatctctcaaaaatgcaaattatcagtactcatcccaaacttaggaaattagaaaacctggcagggagccagcaatgctttaacctgtaggtaattttgatgtatgcaaacatttgaa

SEQ ID NO: 389448 - DNA, 3592 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389449 - DNA, 3665 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattaaaaaacttgta

SEQ ID NO: 389450 - DNA, 2699 bp, Homo sapiens
ggagtcaccttctcacactggctctctccacactggccaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389451 - DNA, 3197 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccaggcgtgttaggacgttacggagggtgttacggagggtcgttacggaggcg

SEQ ID NO: 389452 - DNA, 3104 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389453 - DNA, 2777 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgagtcattagtgtttggtggtgatcatatgcattattccgctcacgagccattataaaacagataacagctatgatacatgattactatcagctcgctataccggatacc

SEQ ID NO: 389454 - DNA, 2759 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtttggaacaaactctcccttcacttgttgccctgtagcactacagaaaccctggttcttgggctccactgagccccaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389455 - DNA, 1914 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaagctcaacaacacaacaaaacaa

SEQ ID NO: 389456 - DNA, 1858 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389457 - DNA, 3469 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389458 - DNA, 3469 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagtcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389459 - DNA, 3352 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagtggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389460 - DNA, 2198 bp, Homo sapiens
aaggctaaggtcgagccggggtgtagtcggccgaggcaacatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389461 - DNA, 2287 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaactggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaagga

SEQ ID NO: 389462 - DNA, 1931 bp, Homo sapiens
tttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattaaaaaacttgta

SEQ ID NO: 389463 - DNA, 279 bp, Homo sapiens
ccacaccctaggccccatcaccactgatcctcccttagacgatggcaaacgcctggctccaggacccattcttcacctgccagggaccatcctaaatgtgatcactgccctcccctgctctaagctcccaggggcccctgcatccagactgaagcccacaatctttttctttttgagattgggtcttgctatgttgtccaggctggatttgaactcctaggctcaagtaatcctcctacttcagcctcctgagtagctgagacacacaatctttaatga

SEQ ID NO: 389464 - DNA, 565 bp, Homo sapiens
gagggaggatctgtgggcaaaggagaatttgaaatccccacaggttctgggaaacaatggaagtcacagggtggggcccttgcatgagaatacattcttttgattttgttttgtctttctgattggctgccagtttcttaatgcaatatgagagcaagagggagctaattctcttcagagcctaaaatccctcgagccgagctggcacttgaacgaagacaaagcttattgagattgggcagggaagttgtcactgtgtgatttgggagtctttcatttggccaatataactccattagattttggaagtgaacccaggtagcagggagggttctggaagtaacattctccaaccagcttgtaattaaaatggaaccctttgaagaactggtcctctctcaattgctccagcctctctctgtcagattgaatgccaggaagccgctgccttaagctttggctagttttctgccaaggcgtttaactctcagttttgtgttgcttgtcaaagtgtccttagagagcataagacactcactttatatttggtgcccacagtatcctt

SEQ ID NO: 389465 - DNA, 609 bp, Homo sapiens
gcaattctcctgcctcagcctcctggatagctaggattacaggtttgcaccaccatgcccgacaaatttttgtatttttagtagaaacagggtttcatcatgttggccaagctggtcttgaactcctgaccttaagtgatccgcccaccttggcctcccaaagtgctgggattacgggcatgagccaccgtgaggcaggggccataaaagaccatttaaaaagaatgcagggagaggccaataaccaagaacaaatatcaaagagagagacagaatcccatcagaaaagtgtcaggaagcctggaatccagggtgagctggatagtaagtataataatacttaataagtattaagtactggataataagtataaattaagtataatatataaaaaaatcctaaaaacaaccaaagacataaaaagctggtaagaaacaatcctacagaaaataatggtgacagaataatccagatatggaagactggaatcctagtgatgtcgagttttgtgcattttttaataatgatgtagttatttctgtcaagactgcgatattatttttatcttttttattatacagatttgttttagtttcgtaaaaaaaaaa

SEQ ID NO: 389466 - DNA, 359 bp, Homo sapiens
atatatataggcacttttgttaagtattaacttgtacagtcacagggtcccacaataggctgtctgcaagttgaggagcaaggagagccagtctgagtcccaaaactgaagaacttggagtccaatgtttgagggcagaaagcatccagcacaggagaaagatgtaggctgggaggctaggagatacatatatatgtgtatatatatgtatacacattatacatatatattatatatataatattataatatacatataatatatattatatgtataatattataatataatattatatatataatattataatatacatataatatatatgatatgtatattatcatattatacatat

SEQ ID NO: 389467 - DNA, 155 bp, Homo sapiens
taaactagccctaaccctaacactgcccaggcctaaagttcagctgcagctgaaaatgtctataaaactgccccccaaccattatcatcaagcaaatccatcccctgtcccaaatacatttcctcttgtatttcttctggcagaatgtttccttt

SEQ ID NO: 389468 - DNA, 273 bp, Homo sapiens
ctggttctataacttgcttaggggaaaaacaggggtggaagacagaagggcaggagaaggtcagagagggactttgtttctgaggctgcttctgaagccttccaatctccttcagattaaagtactcagcatgccacagcgccacacttggggtattattttctgagcccccaaaataaaggcttcaaagatgacatgaaaatattaacagaggtgtttgtgatgggatggtagaacaatgggtattttttctatctagttacatgtgttttc

SEQ ID NO: 389469 - DNA, 499 bp, Homo sapiens
catgaaaagacctggtcctattcttagtagagaatccggagtttttggtttcatcagccatagtgaagttcacatttatgtgcagctctcttatcactgtgtcactgcttatggcattgcatttacctgccctgcttttctgttcactggttgactgatgaatcctacttaaccctttaagttgcagctcaaatgttatctttactcttctacttttcccaacctctcttctggattaaggatccttttatctgagtttccttagcactttaccaaaagctgtattacagcacttatcacactattaaaaaaaatgtttctctttgccctattcgtttcagtgtttcatgaaagggcgggggccatatttaattaatcatcatattcccgtaacctgggacagtgtttgagacatagttagtacttagtgagcatcttataaattgtttggccttatctttattatagaacgtgtatctttagtgacttttttttggta

SEQ ID NO: 389470 - DNA, 178 bp, Homo sapiens
ggaaaacaaatgtaaggagggaattcaaatacctagttaatctattaactactaataactcattaaataaattaataatattaaatggtctgtgtgttccatgtaaataatagaatgatttccactgaatagtcatgatggtttaaaatattactctaataccaataacaacacgtaa

SEQ ID NO: 389471 - DNA, 395 bp, Homo sapiens
agacatcatgattctgctttacacataaatattttaacatgtatcacctaaagttaaggacattttcctagatatccagaataccattattatatctaagaaagtcaacaataattctgtagtatcatgtaatatttagtccctatttcagtatccccatttgtccccaaaatgcttgcttttttgggacacaaagctagcattttaatgaacatttttattagcatttcttttggtacctacagattgatccagtgggcttctcctatttaaaaggattttttggctgggcgctgtggctcacacctgtaatcccagcactttgggaggcctaggtgggaggatcacctgaggtcaggactttgagaccagcctggccaacatggtgaaaccct

SEQ ID NO: 389472 - DNA, 300 bp, Homo sapiens
aaaacagaaaaaaaaatagcagcataagcatgttatttagaaaatatttagataaatttcagaataaaaaattaaaagatcaaaaagttaaaataaattttacttgggttagatatgctgaaaaaaaaaaaaaaaaaacaaagaaacttgtttctgagagcttaacaaacctggaagattaggccaggagcagtggctcacacctgtaatcccagatcacgaggtcaggagatcctgacctggctaaccatcctggctaacacagtgaaaccgcatctctactaaaaatacaaaaagtta

SEQ ID NO: 389473 - DNA, 575 bp, Homo sapiens
tctattttgcacaatatttccttcttgggttgtgtccggggaccttgttcatggcactgaccttccacatgtgcttggtgattcttgtgaaatccttttccataacccagttctcccatcaacatcactccctttgtctctctctttttgatcattgccttctagatattaatttttgttttcatgtttctcctctctcccctggtagtacacagaggccgggcttggccagtgttcattgctgcatatggaagctttctttctcatctttcaaaaagctactgtggttggaattttcgttgcacaaccatttctggcttgttttccttctgggtggagaattgcacttctctgccccttggccttgagttgtgccacacgagtggaagtggcatatgtgacttctgggtggcagcatttaattactggggtgagatcctccggggcttttttttttccccctgaatgaggcaagctctgaagcatctgttgagatggagcctcatgaggtggaagcaaagtggagaactcagccagcacacaaaggagggtggctgcctgtcctagaaagctgc

SEQ ID NO: 389474 - DNA, 141 bp, Homo sapiens
ctcgttgcactcgttcggacgctctacatcgtactgtgactgtgaagaaccctggagtgatccttttaaaattagtcaaattatgtcaattctctattcatacccctccattgacctcctttcttgctcagagtgaaactc

SEQ ID NO: 389475 - DNA, 1992 bp, Homo sapiens
cccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagtttgtggagctcactgtgtctttgctgatccttcagcaaaggaagtgagattgtttctagcttttctgtttggggtgcttctctgtcaactaaaagtcttcatcctttaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaagctcagtggttgagacctaggggttttcaactttctgtatgtttattattatttttttaacggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaattttttccaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcagggacctataatcccaactacttgggaggctgaggcaggagaatcgcttggaggcagaggttgcagtgagccgaggtcacgccactgcactccagcccgggtgacaatacaagactccatctc

SEQ ID NO: 389476 - DNA, 686 bp, Homo sapiens
gaggataatgtatatacattggtattatttaacataataccaatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaaaaaaaaaaaaaaaaaaaaaaaaaaaaaaaaaagggggggggggaaaaaattcccccggaggggcgcccaagtttacccgctatcccccggtttttttgtaccaaaggtgggccccatttagggggaggtcctttattaggccaagggaccggggggcggcgtttttacccactgcctggcgcgggggaacctgggctcttggggcgcttttggggagagagccctactttccggcgcgtgcgcctctgggcccattcacctaagagagttaaggctcagggaacttaacatttcaccggttcctggtgaccccaccggatttcgtgcccggagacgttggctccgctctgttccacattttcagg

SEQ ID NO: 389477 - DNA, 812 bp, Homo sapiens
  misc_feature (179)..(179): n is a, c, g, or t
cagggtcaagaaccagagggagagttcacggaccattcaaatcgctagtgaccaagagaactttactctcggtgacacttctgactagactctactgctctatacgacacctagtgttgggctgcgattcttgggagcgtgcctggatgattacatactcctgtgtataaaaaacatanactatgccttatgaagatatgatcgtcattgctgtagaggctaacatatgaaaccgggctattgggaagagatcctctttaatttatctcttagccgtctgttagcgacgtcttggtagccatatgtctgaacataattacgacgcggactcactggaggatgggaccttggtctcagtgaactcacatgttgagcgctgttctgactttcaccgaaatgaggggtttaaagcagctctctctggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtca

SEQ ID NO: 389478 - DNA, 4704 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389479 - DNA, 4650 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaatgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389480 - DNA, 4052 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389481 - DNA, 4193 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389482 - DNA, 4620 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtctttgtgtttattggtgcaggtagaggatgtaattacttagattcttcttgccttgtgcctaaagtggtagattaatagttcctgatactggtgagtagaaatttgggaatgagagggtgtggtgttttaaataacatgcagtatgttcacattgttcagcatgtaagtaagtgttaaaatatatacattacaaattctccatcctatcaaccagctatctgcttagttcccaccctccccgaaacattaacgcattgttgttagttgcttttgtattactttgtccatatgtttgcaaaaggaaatcaaaatagattcttacgttcttctgctttagtagacaaaag

SEQ ID NO: 389483 - DNA, 1909 bp, Homo sapiens
gttcggtctaagatcagtgtctgggtcggcggtcaaaacaaaatgtggcatgtcagtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389484 - DNA, 4052 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389485 - DNA, 3057 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtca

SEQ ID NO: 389486 - DNA, 3978 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389487 - DNA, 2814 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggtcgccaatccgcggattggcgaccatttcaataaacagttttcccaaggcaaatctcttcagctaatcatacaatttatattccgtgctaaactaatgggctcttac

SEQ ID NO: 389488 - DNA, 612 bp, Homo sapiens
cggattggcgaccatttcaatatcaaccattaaccttccctctacacttatcgtcttcacaattctaattctactgactatccttgaaatggtcgccaatccgctgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggtcgccaatccgcggattggcgaccatttcaagcttttcaattggcaatacttagaaccttactgtagtgacctgattttaaataccatattatatttactaagttaagagctagtttttactctcttccataatttcattacatgaatgtaagatgatggc

SEQ ID NO: 389489 - DNA, 3006 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagtgcaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagagtgacggtggtcccctaagattgtaatggagctgagaaatgcctccgatatttggtgtcatagctgttagaaggaattaagctaacgttgtcgctacattgtgcttactcgttctgatggaaactctactaaatcgatttcttccaccatcgactccccctttcacccttatcgtctatctttcttttgctccaggttttctattggttccgctggcacagacacagagccccccacacatgacccgatccacatgccacagtcagatagataccattcaaatccg

SEQ ID NO: 389490 - DNA, 2794 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtctgcaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagagtgacggtggtcccctaagattgtaatggagctgagaaattcttctgtctattgatgtcacaggtgttgtaatgttatgatgcaaggcactactcacatgtttg

SEQ ID NO: 389491 - DNA, 1564 bp, Homo sapiens
  misc_feature (1554)..(1554): n is a, c, g, or t
  misc_feature (1559)..(1559): n is a, c, g, or t
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaacccgatgatagcttttggaggaccgtcgatgctgaggcaagctaacgctttaagcaggcttatgacctggcttgaaggatcaaatgcttggaaaccttggctnattgnggccc

SEQ ID NO: 389492 - DNA, 2138 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaatgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaa

SEQ ID NO: 389493 - DNA, 1878 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaagctgtaccaggtggaaggattcgttgacaatgccctcatcaagtctttgttccccgagggtcccgt

SEQ ID NO: 389494 - DNA, 601 bp, Homo sapiens
taaaaaaactagtatattattatatatactaagatcattacatgacaccgatctctttcgtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtctgcaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagagtgacggtggtcccctaagattgtaatggagctgagaaattcttctgtctattgatgtcacaggtgttgtaatgttatgatgcaaggcactactcacatgtttg

SEQ ID NO: 389495 - DNA, 513 bp, Homo sapiens
acccaccagcattttgaaagcaggatgagcaagtgctctcggttcctcaatgacacgtctctgcctcacagctgcttcaggatccagcattatgctggaaaggtatgggggagctgtgagcacccagtcaggcctgccaagttacccctgcaaggaggctgtacctcagagatgggcgttcgaaaccccattaacttgtgaggacaaattgagctgctaaagtggttgaatcgataaatgttcaatagaaatagaatctggaccatgttgactaaaatcttattaatacagaaaatcaaaagcaaagctaatggacttaatgaagagtctaaatatatttttgaatcatctttattattttcaaactctaagctatcctataaaaaatatctattaacactattgaaggagatttgccagtacaaattaagagtcaataaagacttaaggctttaaaaacacaagccatttagcaaaaataatgaattatttgagattttgaaatgacattag

SEQ ID NO: 389496 - DNA, 499 bp, Homo sapiens
tatttagcatccttaaagcatactttggattaactgtaataatattggattgtttgatattttggtttctttatgtattggtttccagaaggagtatggataattgagtcagttagacgaagtgagcaaataccctttctcaatccttgtatgcgttacagatattaactacaactgccaatatcttccccttttatcctacagcaacaaaagaggtaccagcagacaaagagttccgccttagtaattcagtcttatatccggggttggaaggtgagtttaaaagaagtatgctttatttattttgggttttctggtttttcacaaaggataatgtctttagggtcaccctgcagaggaggggctcctctgtctcctgcctcgcctgtaaacagtcagatggaaagaataaatattatgggccaaacggggaccctggtgaccatgtcttggccacttccttctaaccagctttctttttaagcgctttgttctctaa

SEQ ID NO: 389497 - DNA, 603 bp, Homo sapiens
cagaaaactcactgtttttatttttatttttttaggtctggtgtggaggtcctatttaatgaattagaaattcccgtggaagaatactcctttggtagatcaaagatattcatccgaaacccaagaacagtatgtaacgaaaacctttacactctgaacttaagttggaatcgtataggaaagttcttaaaatatgtttaactttataacattatatgaggggccaccatgaatgccacaaaacacttgtgtgtttatctacaaataatcaagaggcagggacagataagggtaaggggcggtagaagaatgcgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaa

SEQ ID NO: 389498 - DNA, 4324 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaa

SEQ ID NO: 389499 - DNA, 4106 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389500 - DNA, 3827 bp, Homo sapiens
cccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagtttgtggagctcactgtgtctttgctgatccttcagcaaaggaagtgagattgtttctagcttttctgtttggggtgcttctctgtcaactaaaagtcttcatcctttaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389501 - DNA, 4674 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtctttgtgtttattggtgcaggtagaggatgtaattacttagattcttcttgccttgtgcctaaagtggtagattaatagttcctgatactggtgagtagaaatttgggaatgagagggtgtggtgttttaaataacatgcagtatgttcacattgttcagcatgtaagtaagtgttaaaatatatacattacaaattctccatcctatcaaccagctatctgcttagttcccaccctccccgaaacattaacgcattgttgttagttgcttttgtattactttgtccatatgtttgcaaaaggaaatcaaaatagattcttacgttcttctgctttagtagacaaaag

SEQ ID NO: 389502 - DNA, 3144 bp, Homo sapiens
cgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaagtgtaatgagtatagcaggtgactggtaatttggaaacgttaagattttggaaagtatttaattcatttaagagaattttccagcatctaccttccattagtaatttgcatcctcatagacagtgtgaaggtaaacttaaggtcaattcagcccctctctgatttgtcataaattctgaatcactggaataaaaattgtaagtctttcatgaatccatcaaaataattttctcatggaccattatccatatcatatataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389503 - DNA, 1909 bp, Homo sapiens
ttttttaactcttaatactaagatcatataatatagaagaaaaatagataagcttatgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389504 - DNA, 3490 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaacattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389505 - DNA, 2868 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcgaccatttcaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggtcgccaatccgcggattggcgaccatttcaagcttttcaattggcaatacttagaaccttactgtagtgacctgattttaaataccatattatatttactaagttaagagctagtttttactctcttccataatttcattacatgaatgtaagatgatggc

SEQ ID NO: 389506 - DNA, 1505 bp, Homo sapiens
tgggggttagagggggcactacaggctatgaatgtgggaaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389507 - DNA, 2852 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctg

SEQ ID NO: 389508 - DNA, 2169 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccagcacgaagggaactgagatggctgcagtgaggagaaatcccgggaactgtattgacacaaagattcttattgcacttgtattttttgtattaaagtttgcatggtttctaataaaggattcaaacat

SEQ ID NO: 389509 - DNA, 1578 bp, Homo sapiens
  misc_feature (1427)..(1427): n is a, c, g, or t
  misc_feature (1451)..(1451): n is a, c, g, or t
  misc_feature (1457)..(1457): n is a, c, g, or t
  misc_feature (1471)..(1471): n is a, c, g, or t
  misc_feature (1478)..(1478): n is a, c, g, or t
  misc_feature (1491)..(1491): n is a, c, g, or t
  misc_feature (1513)..(1513): n is a, c, g, or t
  misc_feature (1533)..(1533): n is a, c, g, or t
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgaaagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgagcagacacatctcaacgangtctagtgtgcattcaggacctgngctttngagaacgtcgatcngaggcangtacgcttcagcngctatgacctgctagaagtcanatgttgtacaacatgctatngaagacagcagttgtgtgaggctatatgatagtcgtgagtctctt

SEQ ID NO: 389510 - DNA, 1649 bp, Homo sapiens
ggaaaaatagaggacagtacgcttgtcatgtcctatgtggcagctggttgtggaaaaggagcaaagttaatcaagtaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtg

SEQ ID NO: 389511 - DNA, 735 bp, Homo sapiens
gcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattt

SEQ ID NO: 389512 - DNA, 799 bp, Homo sapiens
gactactgattctaccttatggtgagttgtataattatttcatcatgtattacgatgtaataataatagaaatacagtgcacagtaaatgtaattcacttcagtcatcccgaaactatccccctatccccaccccggatctgtggaaaaattatcttccatgaaaccagtccctggtgccaaaaaggttggggactgctgctctaaggaagactttttcgtgccttggggactgctgctctgaagaagactctttcatgcttcctccttagcttctgatggctcctggcagtccttggcttgtggctgcatcacttcagtttctccctccgtcttcacatggccttctgtgtctgtgtctcgcatggccttcttccctgtgtctgtgtctttccatggcctacttataaggaccccagtaattggatttagggcctgccctaatccagtctgatttcatcttaactaactagatctgcaaagactctatttccaactaaagtcacattctgaggtttcaggtagacatgaagttttgggggacaccactcaacccattgcagaacccattagcagtcacttcccgttcctcaacgccccctaccccagggcaatcagtaatctactttctgtctgtttggatttgtctattctgaacatttcatataaatggaatcatagaatatgtggtcttttgtgactggcttctttcacttaacatgttttcaagatttatgttgtagcatgaatcagtactttattactatttatggaataaaaatcagttgtatggatataaa

SEQ ID NO: 389513 - DNA, 1069 bp, Homo sapiens
  misc_feature (827)..(827): n is a, c, g, or t
gactactgattctaccttatggtgagttgtataattatttcatcatgtattacgatgtaataataatagaaatacagtgcacagtaaatgtaattcacttcagtcatcccgaaactatccccctatccccaccccggatctgtggaaaaattatcttccatgaaaccagtccctggtgccaaaaaggttggggactgctgctctaaggaagactttttcgtgccttggggactgctgctctgaagaagactctttcatgcttcctccttagcttctgatggctcctggcagtccttggcttgtggctgcatcacttcagtttctccctccgtcttcacatggccttctgtgtctgtgtctcgcatggccttcttccctgtgtctgtgtctttccatggcctacttataaggaccccagtaattggatttagggcctgccctaatccagtctgatttcatcttaactaactagatctgcaaagactctatttccaactaaagtcacattctgaggtttcaggtagacatgaagttttgggggacaccactcaacccattgcagaacccattagcagtcacttcccgttcctcaacgccccctaccccagggcaatcagtaatctactttctgtctgtttggatttgtctattctgaacatttcatataaatggaatcatagaatatgtggtcttttgtgactggcttctttcacttaacatgttttcaagatttatgttgtagcatgaatcagtactttattactatttatggaataaaaatcagttgtatggatataaaaaagagaaagaagagagtatcttaatangggcggaggttatccgttagtgaggtaattagctgcatgcgcggttcaagcggcatggacctgggtacaataagcgtgggacccttcgcaggggtatgaagcgccttcctccacatgggtcgtaggagagcctccaccgagtggtgggagaattggccgcttttctttcagggccaaaaggctggtttcccaaatggcggccaacctggttacgccaatgttcggaaaataagggccagcag

SEQ ID NO: 389514 - DNA, 464 bp, Homo sapiens
tttataaagaaaagaaatttatttctcacagttctgcaggctgggaagcccaaggtcgaggggctgcctttggtgacttatggtgaggacctcgtgctgttcccgaacacagccaggaaccacgccaagaggaagatgctccagcacagccttgctgtggaccaggccgcccacagggagcaggtccattcctgggggctgactccgcctttcagagaggcgtggctccatcttcacagcctcgtagcctcttaaaggcccagcctcaaaacctcattggggcccccagccccggtaaataaattgcattcagaccatagtgccagccttttgaagccaatacttttttggtcgttcgtgcatcttttgaattggttttatttcgattttgccgtttctcttctctctggaagttacagactttccactttttggtcgttcttgcgtcttttgaattggtttta

SEQ ID NO: 389515 - DNA, 580 bp, Homo sapiens
ctaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaagtaagtcagccacaaaagaacaaatgttgtaccattccacttaaaggaggtccctagagtcgtccaactgatggacacagaaagagtagaaggggctggagtctggggctggaggaagggaatggagagttagggcttaatgggaacagagcttcagtttgacaagatggaaagagttgtggaggtagataggggtgatagttgcacaacattctgaatgtatttaataccatggaaccgtgcacttaaagatgatgaagatggtaaattttgtggtgtgtgtattttactagtaaa

SEQ ID NO: 389516 - DNA, 9007 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389517 - DNA, 9088 bp, Homo sapiens
tttggagttgaaaatgttgtacttttctaggagccatttccccaggccatgtggaggtcaggtatctgctggttctggcctcactctactcctcctcctcctccccgctctgtggagagggtggcttgaaggagacgggcagcaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389518 - DNA, 9130 bp, Homo sapiens
atggttctcgggaggggcggggccacgctgcgggcccgggccatggccgccgccgatgcgcgagataggtggtcttgctctgtggccctgctggagtgcagtggtgccatcatggctcacttcagtcttgaactcctgagctcaagtgatcctcctacttcagcctcctgagtagctgggactacaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389519 - DNA, 8813 bp, Homo sapiens
cccgctccacccgacggggtggggagtgctgacacagaggacaggaagctcccggcccctggcgccgacgtcaaggtccacagggcacgcaagaccatgccgaagtccgtcgtgggcctgcatgcagccagtaaagatcccagagaagttcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389520 - DNA, 5090 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatactttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttt

SEQ ID NO: 389521 - DNA, 8863 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaaggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389522 - DNA, 2837 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcagttctgcaggctgggaagcccaaggtcgaggggctgcctttggtgacttatggtgaggacctcgtgctgttcccgaacacagccaggaaccacgccaagaggaagatgctccagcacagccttgctgtggaccaggccgcccacagggagcaggtccattcctgggggctgactccgcctttcagagaggcgtggctccatcttcacagcctcgtagcctcttaaaggcccagcctcaaaacctcattggggcccccagccccggtaaataaattgcattcagaccatagtgccagccttttgaagccaatacttttttggtcgttcgtgcatcttttgaattggttttatttcgattttgccgtttctcttctctctggaagttacagactttccactttttggtcgttcttgcgtcttttgaattggtttta

SEQ ID NO: 389523 - DNA, 1336 bp, Homo sapiens
  misc_feature (1271)..(1271): n is a, c, g, or t
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgnttctagtcttactcttttttttattaatctaatatgcattcatttttttttttatattggattgt

SEQ ID NO: 389524 - DNA, 371 bp, Homo sapiens
cggtgccagtttagtagtactttatttttctaaatattaaccccaattaaaacaaaaatttttttttgtcctcccatttttagggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcaggtacctggcacaggctctggctgggctctccagtcgtccacctgaaaaagtttcagttgtt

SEQ ID NO: 389525 - DNA, 377 bp, Homo sapiens
aacccggctgacggctgttgtttctctctaacaggcagttccggcgaggggggagcctcagcaggattgctgtgtgaaaaccgagctgctgggagaaggtgagggcggtgtgcaccgagggacaggagcagcgcctccctccagactagaaaacctgctgctcttcctctcttattagtccccgtcttctgactttctttgcttcacctaggtttatggtatagtttctaatctatcccattcctaaatagcacagttgcacagacaaacacaaaagctctgccagagaaggaacacatttgtcaaagtatgaaaagcaaaaatcctgtatatccttgtcttaaagtacacccagaaaattaaaagtgagtggccac

SEQ ID NO: 389526 - DNA, 2712 bp, Homo sapiens
atggttctcgggaggggcggggccacgctgcgggcccgggccatggccgccgccgatgcgcgagcccgggccatggccgccgccgatgccgagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaagatacagaaaacttctaaagtttatacggagtctcaagagacccagagaagccaaacaattttgtgaaagaacagagttggagaactcacacttgctgatttcaaaacttactatatacggccacagtaatgaaaacagtgtgggactggcataaagacagaaatagagaccaatggaataaaataaaaagcccagaaat

SEQ ID NO: 389527 - DNA, 9028 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389528 - DNA, 8972 bp, Homo sapiens
atggttctcgggaggggcggggccacgctgcgggcccgggccatggccgccgccgatgcgcgagcccgggccatggccgccgccgatgccgagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389529 - DNA, 8929 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389530 - DNA, 9063 bp, Homo sapiens
  misc_feature (981)..(983): n is a, c, g, or t
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcccccnnnaaaaaaaaaaaaatttttttttttgggggaaaaaaaagaaaaaggccccccttttggccccgaatttgtgccccaaggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389531 - DNA, 8445 bp, Homo sapiens
ctaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaggcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtgggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaagtacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 389532 - DNA, 1934 bp, Homo sapiens
atggttctcgggaggggcggggccacgctgcgggcccgggccatggccgccgccgatgcgcgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcgcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgcgggccacactctcggaggagacaagctgaggtgcagcttcacgtgccgagctttgatcaacggactgtggagtggagggcactcggcttccaggcagggaggaacttggaggggctataggcctgaatggaaacaggaggtggtcaccaaaaggtggttttcgcagcagggcaaaaggtctttgtgtgggggtgcccataaggacgaaaacgcatgggcaggagagacaggatcgctatgagcgggaataagacgtgaacaatagtagggaacatatagagaacatagagtagagagagtagcaaagaatatatggtgatatggtagctattctgacgt

SEQ ID NO: 389533 - DNA, 424 bp, Homo sapiens
gggttccggcgtggctcgaggtggctgtttatgtggaggatggtcatttgtgagtgcttgccagccatcgtgacagtcctgagctggagtctgtggctacatctgaaatcattaataaaactgtgtttgttcacagtggacggaattgaccccaacttcaaaatggagcaccagaataagcgctctccactgcacgccgcggcagaggctggacacgtggacatctgccacatgctggttcaggtgcggcggcacggcgccctcctagggctcttcacctgctctcttttatttttaccaaagtaaaatcataccacgttcgcggttcttccagtgtaagagttccgtagtgctgtgaatcgggcacagagtcagcttttctgcccccgagtcctgcaggtggatcagtgcttcccgctgtttc

SEQ ID NO: 389534 - DNA, 484 bp, Homo sapiens
catttgagtgagttgccacgtgtgcgtggaaatgcgtttctgtgttcagggcctcgttatcagtaatttgggtgacctcagtccccgggaaggtgccagtgccatgaagctcctctgccataggggcagagtgttcgtgtccaagatcattgtgggggactccaccccgtcctccctgccctcctcaccacagcccacctgtctgccgggctcttctccaggtggcaggggcacctcttcgtgtgtccccgcctccccacaggcccttgcacctcccagtcacccaagactcctcagtgaaagcaagtttgttcatgatgcgcactgatcctgccttggggtatacacctgcccgtgttggggagaaggacctgggcgccagcagcctgcacgtgaatggggagagcctggagatggactcggatgaggacgactcagaggagctcgaggaggacgacggccatggtgcagagcaggcggccgc

SEQ ID NO: 389535 - DNA, 315 bp, Homo sapiens
gtagtgactacaggggagaagaggaaacaaaagaaggtttagaaagataagtagtttgccaagttcattcaatgggaacagaatagtctctttgaacagatagatggtgctgggacaactggataatcacatgccaaagaatgaagttggactcctacctcacaccatatacaaaaattaactcaaaatggatcaacaacctaaatatatgagctaaaaccataaaactcttataagaaaacaggggtgaatcttcatgacccaatatttggcaatggattcttagatatgatgccaaaagcacaagcaacaaaa

SEQ ID NO: 389536 - DNA, 586 bp, Homo sapiens
cctcatggttttgccgagggctgtttcaaaggttggtgcacctggagaaagccttgccatctgctccctttggacagcctcaagtttgcctctgctggaagtgagcttccaaaattagtctggaacattaaaaacctcggtttccattaattcagctcaaggtccccaaggactagcatatttaatctagatttagctgattagcctgcatttcgctgtgtaattcccatccttggctgctaaaatgggaggaaaaaagagcaagtgaaagtaacaagtcctgtcgggatttggctcaaggcaggagttagagaagccaggtggcagactgcctgggaggaagtgcagagtgggaagcaagggtgaggcagaggtagagtgtagagttgaaggtcagtgaaggtgaagaatgagtcttatgaagtagttattgatgcaagggcaggaatctagctactgacagatcatcaaggattaagagaaaatcttacacaatacttaccagagaacaatgacattgaactttgttcctctgaccggatgtggatctcaaaatgtgagttcagtgtgggagccaagctagcac

SEQ ID NO: 389537 - DNA, 632 bp, Homo sapiens
ccccactggagcatattacgtttgcctaagatgtataaaagtttgtttaagatgtgtaaaagtttgcttaaggaactgaggatccttaaataaaaatattagaaattagaaattgaacctaatactaaacagtaaattcagcttaacctgaaccttggcatagtcagagcttcctcctacatctaaagtatttgctctctgttttagttaaagtcataatttgcgctgatgtgtaatcactttccaagaagagggcaatgagaaaagatatttaaagctttctctccatagccctccaagacttctgggacaactaaatttactttcaccattactgtgagaggaggtgagaaaactctagtattttgttggcagagtaatcactttgttctcatcgctcaaagcatttttaggattatttttctagcgtaacctttagagagaactggaagaaaaaggaaattggtctactaggtattgtagacacaaataagtaacattaggctaaccccttatgagacatttccacacaatttcatcgtgcctgtacttttctctatggtaaaagccagtgtttacactttgtagggatcagggtgtatttgttgaattaaacaaaatattttcaatga

SEQ ID NO: 389538 - DNA, 355 bp, Homo sapiens
cgcccctatgcttcttgtgttcaagtgattcttgtgcctgagcctgctgaacagatggggttacagacgcatgcgcccagacccagcgttttttgtatttttagtagagacggggtttctccatgttggtcaggctggtctcaaactcccaacctcaggtgatccacccgcctcggcctcccaaagcgctgggattacaggcatgagccacagcgcccggcctaaggggtgctcattcttaatggtgttctgatattgtaggtctgcaggacccaatacagtagccagtagcacatgagtttttgaacacttgaattgggactagctctactaaaagactgagaggaggtgtgct

SEQ ID NO: 389539 - DNA, 404 bp, Homo sapiens
tcttgtaaatttgtttgagttctttgtagattctggatattagccctttgtcagataggtcgattgcaaaaatgttctcccattctgtaggttgcctgttcactttgatggtactttcttttgctgtgcagaagctctttaattagatcccatttgtctgttttggcttttgctgccattgcttttggtgttttaatcatgaagtcgttgcccatgcctatgtcctgaatggtattgcctaggttttcttctagggtttttatggttttaggtccaacatttaagtctttaatcaaatttgaaaactacatatctcaatagataccgaaaaagtgtttgacaaaatccaacatccattcttgatttaaaagttagtttaaaatctagttaacctctcagctaac

SEQ ID NO: 389540 - DNA, 269 bp, Homo sapiens
actcgaaggcgagtgttagaagcaccctggcctcccctgcccccaagtcctgagatgcactagggtcatgttcgggcctgtcagggccacactggaaggtcacaaccacctggccctggcggtgaccctgggcctgggccaggagcagttgggctgcataggccgtactgagagagcagctgaccctccctgactcacgacaagtgccgcattccgaggcggcccggccaggctggaaagcgtgtgtgtctgtgtgtgtgtgtgtgtgt

SEQ ID NO: 389541 - DNA, 609 bp, Homo sapiens
atcatcgagagtcgactgtgggcttgaaaggtgtagagaaggccagtcgatagcataacgtcggtgagggaggtatcaaatggtgtcatttgtggatacttggaatctcaaaaaaaatctcatcactaggaaatgatggcaaaaataaataaaaattaaaaaataaaaaaagagcagaagaaatatttgaaaaaaaaatggccaagaatttagttacagacatgaaaactccagaaccaagaagcccaccaagcatgatgaatatcaaaaaacacacaccaaaaaaaccccaaaacaagaaaaatgatagcaaatccccaaatataggtatatcaatcaaattcaaactgctgaaaattaaaatcaaaaacagttttgaaggcagtccaagtaaaaaaatacatgactgccatgcatacgttaactataggaatatggtctgagaagtacatcataggatgatttcatcattctgtgaacatcatagagtatgcttacatgaacctagattgcagttgtgtagcttattgtacctgtaagctacatagtacagctgaatgcttttaggctataaacctgtacagcacgttactgtactgaatactatag

SEQ ID NO: 389542 - DNA, 254 bp, Homo sapiens
tctatatggtgataatgcttccttctgggtaatacattaatacacaatttaattctgtaagatatcattgaataaaatatgctaatttaaatatagcatatttggcattttaaaactttaatagcaattttaaatttttctaaagaatgaggatactcatagaatcattaaaaatttgaattattcaataaggcacttaaatcggtgtgagatgactaaagccaacaatatttttcataaattatgtaggtgac

SEQ ID NO: 389543 - DNA, 341 bp, Homo sapiens
tcttcatcagggttttgtttttgttgctttaaagcaagagttaagtttatagtctgttaagctcttacaaatttggcttattagttaaatggacgtagtttagcttaaactttatgttagagtgagatgaaaccctatgaatataatcagttttagaaaaactaatcagtttattgtgcatcagagacgtcacatgaagaagaaaacttgttgacatccaggatgatcaggagccttcattaaaacagaaattttagggaaaaccacaaaaaccttcgtaaagtgaattgcattaaacatcaattataataaaatttcatattttgaataaatgacatttt

SEQ ID NO: 389544 - DNA, 347 bp, Homo sapiens
cagacgcacactaccatgcctggctactttttgtatttttaggaaagatgaggtttgccatgttggtcaggctggtcttgaactcctgacctcaagtgatccgcctgccttggcctcccaaagtactaggattacaggcgtgagccaccacacccagcctgaaaattatatcttgtgctcaagatgattacaatttaatagatttgtttataaaattttagagagatttaattggccttatgctgtctttatcttttgagaagaaattccctcaaagaataaaggtttctacatttttttttgaaatctttgagttatctcagcaccataggaaaggtaaaaacaga

SEQ ID NO: 389545 - DNA, 979 bp, Homo sapiens
ctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgttaaaaca

SEQ ID NO: 389546 - DNA, 772 bp, Homo sapiens
ccgagtagctgggattacaggcatgcaccaccatacccagctaattttgtatttttagtagagatggggtttctccatgttggtcaggctggtctcgaactcctgacctcaggtgagctgcccgcctcggcctcccgaagtgctgggatcacaggcgtgagctactgcacctggccagatgtgctttctttatcctttgaacctctaaaatccttgagtccttgctatggctttatttgcatttgctgcttaacaaacatttactgaatgtctttcacgtgccaaccactgggctgggtgttgaggttggggagatggagggacaagatagagaggccagtgggaaggtgacttcagatctaggtaagatactatctttccctagagaagttcacattaacagtggttttctgtcttggctacacattagaatcacttggggagcttaaaaagatcgaagtgcctgggtcctaatcccagagattctgatttaatggttttgggatatggccaaaacattgggagtttcagaagctcctcgggtgattctaatatggagccaaggttgagagctattgtgctaatggaagagacagaccgataaatggctaatttcattgcttccaatgccagaagaatatacagggcacatggggaacaggagtatttaatttagcctagagtgatttttattgtacaactagaccgtaagctgtttatgggcagggcccagggctttgtcatcttggggttctcttgcctgattcttata

SEQ ID NO: 389547 - DNA, 319 bp, Homo sapiens
ctggggtctccagacaccctggctcaatgcctggacactgttcaaagctgctacagctagagctggggaccaagcaccaggacccctgagttccaggcccaactcggtggctgatgtgctgcgggagcttgggcaaatccctacccctccattggcctcagtttcctggaaggcagttgaataagattgctcctgtccgtgaccttcctccataatatcatctgtgacaggctggacatttgggataccacaaagtagtccctcctgcatggaacccaggccccaggttatttaggatctctccttggtaccaagcgct

SEQ ID NO: 389548 - DNA, 392 bp, Homo sapiens
cctatcacaggcagtgcccagaacatccgcatccacatccacccacaattgcacactgggagtcccgctctgagtggtggagagcagcagtgagaagctgggaggaggcagaggggaggacagaggaggaggctgacacaggtcacacgagcggctgctgggcctcggaaggctcagctacaaaatgacaaggggaggcagaagacttctctcttaatatctgagtaaaagccaacgcaaaagccaccgcatttgtcttgtgtcacccatgggcccaactggactgttcattccttcattcaacaacaatggactgagtttcccctgggtgctgggcactatgctggccatctggggacagcacactgagacaggggtcctgtccttctgga

SEQ ID NO: 389549 - DNA, 161 bp, Homo sapiens
tttttaagtgattgtgaatggtattgatttaattttgatatccacatattcattgttcaaaaacatatcttgtttgtctgagtttgttttgttttgttttgtttttttgaggcaaagtctcactctgtcacccaggctggagtgcagcggcatgatctggg

SEQ ID NO: 389550 - DNA, 586 bp, Homo sapiens
atgggtgctggcaagacaaagcggtaaagaagcagagtgtgaagcagcaggagccaggcgtggagaaggatctgcagcgcgccggaagtggaagctcgggtggtagcaagaaaagcgagaggcagacgtggaacacagctagggctcgggaatgggggagcactggagaacacgctccctcatctctccttcctgtgaacttgctcaaggacacttctgcctcccccagctcccatgtaggtcagcttctcccaggtgtccaccaacacctacctgtctttaccacaaatccccaatatcttaagatagcttgcattcatctttgctcctttaactgaattagccaatggttcgcttctttgagtccatttccttatctaaaaaatggcaacaattattcctgccttccctcacagggtggcttgggacctgtggtggtgccaccacacacagagaccacgcgtggtggtgggtgcctatagctactcgggaggctgaggcaggagaatggtgtgaacctgggaggcggagcttgcagtgagctgagatcatcccactgtactccagcctgggcgacacagtgaga

SEQ ID NO: 389551 - DNA, 173 bp, Homo sapiens
ggaagaggttgatcaaatccaggtctacctgatcacaaagataagtttttaaccactgggccgtattaccacccttagagaatgtggtcaatcccgtgtcctcatttttacatctgtaactgccagctaaatgaggtcaagtaacttgctgaaggtcacagagtcaaaagtgg

SEQ ID NO: 389552 - DNA, 260 bp, Homo sapiens
gggaacagtagctaggattttttaggggggggtgctagtttaagggtttttggaagaggtgcacatttatgtgtgtgtgtatgtgtgtgtgttgcactgatgcaaacaactatattgttgtaagtcaagaataatttaactagtttttagattttagaggagctaggctgagagaaagaaatgcattttaaattttatttacaggagtgtaccttgcttgttaaaaggttttaagaaattcttacttactttgaaaagca

SEQ ID NO: 389553 - DNA, 323 bp, Homo sapiens
attgtactaggccctgaagatactgtagtaaacaagacagacaagttctctgttctcttgaagcttatattgtagtgacagtaaacagagtaagcaaattagaaaacaagttaacttcaggcattttagtgacatgagaacaacaaaaacagcagggtgatgtgaggcaatgggatatgagaatggctgagaggcctactctggagtaagtctgcaagtgaaatcacctttgatgaggtgatgtttgagttgagacaggaatcacagaaaggagccaattagtgaagatctcagggccaaccatgccaggcagagggaataag

SEQ ID NO: 389554 - DNA, 387 bp, Homo sapiens
acgagaggatgatgcctgatgtgtggtctcaaatccttctcagtacagcctcccaccaagcaatcacatatggcacaagagccaaccctactgaacatcgctgtgccagacgggagtctttgagttcttttgtgggtccctagtacctggcacatagtaggtgcttattccatgctgcttgactgaataaagaccactggaactaagacctgtatgttctgaatccggcttcagtgctttctcctggttttaaggcaaaatatgtggcctctccagcaggtcttgttggctcgctccttcaaaatacaatttttgtggcgttactatatgcctagtcctgtgttaggccctggagatagggtgatgaacaagactttatgctcccct

SEQ ID NO: 389555 - DNA, 200 bp, Homo sapiens
gtgattgtttggtgatggaatcatgcgggcggagggaaatgatctgtttgtgcttgaatctgcctctaggtagggaccacatgactggctgagccattagtcataggtatgaatgaggtcagccggttgccagaatgcaaaagaatgagaaacatctcaaaagaccagtctcgcgttctacaatagtgatgttatctata

SEQ ID NO: 389556 - DNA, 182 bp, Homo sapiens
gtctaaaacaaacaaacacctgtagaaccagataaaaaattagtccttatgtgggatagattgtgtgttataaattcacaaggatatttaaaaattgtcataatctttcttttttcaaactcagtataaaatgtgttctcataatagtatagcacatgtttgaactgtgtttctagcagctg

SEQ ID NO: 389557 - DNA, 323 bp, Homo sapiens
aaactcctgggctcaagcatctgcccgttttggcctcccaaaatgctaggattccaggtgtgagccactgtgccccaccaacatgatgtttatatattgtggcatgggttaatcaagctaattaacatataggcattatctcacatactcttttttttttggtaagaacacttacaagtatgcaatacatgttattagctatggtcaccatgttgattatagatctcttgaacttattcctcttaacagaaattttgtatcttttgaccaatatctctccaataccttcttcctacagcccttggtaaccatcattgtactct

SEQ ID NO: 389558 - DNA, 305 bp, Homo sapiens
ttttctgacatttgatatcaggcaacacaggacagtgatccacaagataaggaaaacaaataagttgagtttcccaggttcctgcctggaaagagtttcgagggtacagcacagggaggagaaatccaagcagagcccagcagtctctctaagttgaggaagtgaatctgggaatctgggagggtcaatggagctagagttcccagggcagaatatcagcacactagagagaagagaactgcaccgagagagcagcagaggtctgcagagggctccccaaaagtcttcagctgggtacccatcag

SEQ ID NO: 389559 - DNA, 1108 bp, Homo sapiens
tggaggggagcctggaagccccacggggctcactagctgatgcctgagcccttctggggagctgagccacatccaggggttcaggttttgcttgctcctcagtggtgcaccagtgactttggtcaggagccctggttgccacaattgacgtctgagctgctggcacctggcagaggcctgtcagcagccatgggtggggtcagcgcagggaatctttccaagaggcccaacagtgtgactcacgccagggttcctggaggtctgcatagagtcggggtgggcgcctctgctcatgttaacctgtgcccacctaggtggtatttgagcctgtctatctttgctcagtggagtgcccatagccaaggtagtggcaggctcttctctgcagctgtcatctcccctggcatcaacagagcctgggccgggcgcggtggctcacacctgtaatcccaacactttgggaggccaaggtgggcagatcacaaggtcaagagatcgagaccagcccagccaacatggtgaaaccccgtctctactaaaaatacaaaaattagctgggcatggtgatgtgtgcctgtagtcccaagtaactcgagaggctgaggcaggagaatcgcttgaacctggaggtagaggttgcggtgagctgagatcatgccactgcactccagcctggcgacagagcgagactctgtctcagaaacaaaaagaacaaacctccccccggccaaaaaaaaccaaaaaacaaaaacagagtctgacacaggaaggacctgagacctgaagccacacagccccactctgcacatgctagagatgacatggcaagcccaggctggtgaggataaaagtctcagccccagctgggtgcagtggctcaagcctgtaatcccagcactttgggatccaggcagacggattgcttgaggccaggaatttgagaccagcctggccaacacagtgaaaccctgtctctactaaaaatacaaaaattagccaggtgtagtggcccatgcctgtaatcccagctactggggaggctgaggcatgagaatcacttgagcccgggagccggaggttgcagtgagccaagaccatgccattgcac

SEQ ID NO: 389560 - DNA, 515 bp, Homo sapiens
cctggtcaccccacctctgtgtcctgtctcttcagataccctgctcgccacccgccgaccattcttcccagcaagctgtgttatcttgtcattcctgtgctcaagaacccagaatctcttctaaggcctctaagacaagatccaagcttcttctcccagaattccaggccttcctaaatctgacccctggtctctgaagccccctggtcacctgctactggagcccaggtgctctcctctcactgaagcttcctcattattcccaagacacacgccagtcgcttttgcctctctgatgttgagtgaaacagtgaaaggagcatgggctttgcttcctgtgtgtctctaggcaagtcacccagtgtctccgtgcctcctgctgcttacctgggaaatactttaaagactgttgtgagatgagaatgtttgcgtacaaagtgccagccacacagtaggtgctcaatacatgcacagtatccgtcataccatgctcttgctgctccctgacttgatgg

SEQ ID NO: 389561 - DNA, 599 bp, Homo sapiens
cacagcaaggcaacactacaagaaaacttaagtcagaaactgccctaatttcagtgtcggaaaatggacagtaacatatcttgtaccaagaggagcttaaaaatgccctgacaggctgggcagggtataatcccagcactttgggagcctgaagctgggggatcacttgagctcaggagttcaaggctagcctaggcaacattgcaaaactcttatctctacaaaaaaaaaatacaaaataattagcaaataaaaaataattaggcagtggcatgcacctgtggtcccagctactctggaggctgaggcaggagaatctcgagcccaggaggcagaggttgcagtgagccgagatcatgccactgcacttcagcctaggtgaagggagtgaaatcctgtctcccaaaaaaaaaaaaaaaaaaaagctaaagaattataggtaatttcccataagacgttgcgaactgtagggagaagctggcctgggagagggaggaaatgaggtgtggtgggtcaggcacagtggctcactccaataatcccaacaagcaggaggattgcttgaacccaggagttcaggaccagcctgggcaacatag

SEQ ID NO: 389562 - DNA, 477 bp, Homo sapiens
ggcatttcagactcttattgttgtataaggagccatttgaggagactgtctccaaaggtagttgatctctttctgccacaactagttcaatcaccaggggaatatcttggagttagttgtaactaaatctgctcaactaagaatacaaattcccactgcccccttcatttcatcataatctcatttaacaagtttttttgtttgttttgttttgttttgtttttatttgagatcatgccactgcacttcagcctaggtgaagggagtgaaatcctgtctcccaaaaaaaaaaaaaaaaaaaagctaaagaattataggtaatttcccataagacgttgcgaactgtagggagaagctggcctgggagagggaggaaatgaggtgtggtgggtcaggcacagtggctcactccaataatcccaacaagcaggaggattgcttgaacccaggagttcaggaccagcctgggcaacatag

SEQ ID NO: 389563 - DNA, 213 bp, Homo sapiens
  misc_feature (175)..(175): n is a, c, g, or t
cacagcaaggcaacactacaagaaaacttaagtcagaaactgccctaatttcagtgtcggaaaatggacagtaacatatcttgtaccaagaggagcttaaaaatgccctgacaggctgggcagggtataatcccagcactttgggagcctgaagctgtctttaatggttccaganagttctctggctaaggatcggtgccgcatctgtcgagc

SEQ ID NO: 389564 - DNA, 281 bp, Homo sapiens
atgggaatcatgggtattgctagtgttttctcaaaaagaaagaacactcataagggaagtttatatgtctagaaatgtaggacagaccagtctttagagggaaaaaatactcatctagcagtataatatttcataagaaaaagaagtgtctcgaataggaaagatgatttactttttgtgctattaataaagccttaataaagggatttttaatgtgaatatgccatgatcattctctcctgtatggcgatagagtaatttggctacttatagggtattca

SEQ ID NO: 389565 - DNA, 397 bp, Homo sapiens
gccagcagctgcacatgaagggagattttggaacaggcctggccagaggcgaatcactcatcccagcagtcagaactcagcaagcctcaccactatatgcttaagtgctctgaggttctaggtaaacttgaaagacagtctaggacacaaggattgcaattcctaggtaactcctagtgctgggctgggctcagaaccagagggataggggtggcacatgacctaggaagtcatcagctggggcagctaagggagtgcttgtgccacccctcccctaatcccaggcagtgaagcttgcagcaacaaaagtcactccttccttctgcttaaggagaggagagaaaagagtaaagaggactttgtcttgcatcttggataccagctcagccacagtagg

SEQ ID NO: 389566 - DNA, 579 bp, Homo sapiens
acggatcgaagcggctgggttgggcggtaaacaggccgtgggtagggaggacagagaggcggcgttcgctcctctgggacttttcacgcctcgttttgttttttttcttcagatgtggctttttcctgacgcagggtccaagcagtcagcttgagcttactcttctgtgaaagcggaaagtctcctctgaggaaagcggttgaacttgtggagggcgtgcgagacgggcgttctcccccatgccaggcgaatggtgcggccttgagctggtccagcagccggctcgatgacaggtctgagggaggccccagaggcggcgggaaggtggcccgcagaacgcgggttctgtaaagacacgtggagaagattcgattccgagaacaggaagaggcggatggaaagacagccaggcggctgccgggaagggggctgccaagatggcgtcggcctcctcccaaccgtcgttggcggtcggtttttcatcctttgatcccggggccccttcctgtaccgcgtcctcagcatctggaatcttgagccccacggcatctgaggtgccttatgcctctggcatgccca

SEQ ID NO: 389567 - DNA, 356 bp, Homo sapiens
tctggcatcacatggggatctcaggcagaatagaccacagcctctcatgttttaagaaaatgtggttttgattctataatagaaaactcacaggccatccaagagaattccaaatgacgaaatgaacagagcaggcttcattaccacacggagcctccctctctgtggaggcatttggaatttggtgaggactcaccatgtccctataacaagaaccagggcagtatctggaacctgcaccccaaggcctcccagagaggaaaacaacagggcattcccagggaatcgcgccttccccttgctctcatctccaacctgccccatctcctggaaaaacatagaataaactttctgct

SEQ ID NO: 389568 - DNA, 373 bp, Homo sapiens
acatcacccagccaaatgtttcctgctccttagacacaagtcacccttcatgctgtttcagtcaccatgcccacacatctgtccttctatgaagatctagtcaatgccatctcctcccaaaagtctttcctggttatggccaatccatgatcatctcacacctttgaactgcaaaagcacttcttactgctgattaaaactatcactttttgcctggtattctaagcattcttaaacggagatgacacctcgagccctcggctagcctgtaaacgccttgagggcagcacctccaaccaaacaccctgcacataaaagggttatctggatgtgatgagtgatcgtgttacaaccccacgatcacgaacaggga

SEQ ID NO: 389569 - DNA, 326 bp, Homo sapiens
tggctttacctgttttctatgtggccagagtaccctcctgatggctcttggtgaataaaggagccaaagctaaaagttagaggctccagtctttggaaggcgtcttcagtaaaaatatcctttggggatgcttagttattctaagaatagttatagatctaataaatattgcctttgaacggttaagtttggatatgcaagaaggccagctgtgagaagaacaggcagccgtgcaagctggcaaagggagaaaaaactgtttagggataggagaaaacagatggatgccttaggccagctgtgtctgcactcaggagcccaggttg

SEQ ID NO: 389570 - DNA, 715 bp, Homo sapiens
gaatggaaaatgtattccatgcaaatggaaaccaaaagaactgggatagctatacttaggtaaaatagattttaagtaatgtatacaaggagacaaaggtcattgtataatgataaagggatcaattcaagaggatataacaattataaatatatatgcactcagcatcagagcacctaaatatataaagcaaagatataaagatctgaagagataaactgcaatacaataatggtaggggacctcaatacccattttcaacaatgtacagatcatgcagacagaaaatcaatatggaaatgttggaattgagccacagtttagacaaatggatctaacatatatacagaacatttcatccaatagcaacagaatacacattattttgaagctcacacagagctttctgcagaatagatcatacattaagctacaaaagaaaacttaacaaatttaagcaggttaaagtcatatccagtatctttcaaccacagtggtatgaaattaggaattaataataggaaaaatgtcagaaaattcacaatatgtagaattaaaccaaattctcctgtacaaccagtgggtcaaagacgaaagtaaaagggacattaaaaattgtcttgagacaaatgaaaatggaaacaccacatgccaaaacttgcgggtagcagccaaagcagtcccaagaggaagataatagcaataaacacctata

SEQ ID NO: 389571 - DNA, 186 bp, Homo sapiens
cagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccat

SEQ ID NO: 389572 - DNA, 225 bp, Homo sapiens
cccaactttctcagttactctcagactctagagtgttcgccagccttggagcgtacccgttcctccagccattcttcggcctcagttcctttccatcattcgccctcaggccttcgcctaccccagcttcaaagaagcgaccgtaacctcctagctggctgggttcgagaagccggggacctgcgcctcctggtggctgatcggaaggaggctgagtgcagaggg

SEQ ID NO: 389573 - DNA, 349 bp, Homo sapiens
cccctgtgttagggttagatttaggctatgaccctggctttatggctagatagtttgatttgggctttgtccccatagtgtctcctacccttttttggaataggacagcattgcacattgaacagtcactgagcccaagctctgtactttggtatttgggagagctttgaagataaaacacctgatctctggcttcccagaagttagtcttgagaaatgcaatcagttagttggaatagttagctgcaactaagtgttaaatcttaggatgctaactggatttacaatagggcatttagaaatgttagagatcaaagtgtactgaagatatgggaagtggcttcatttt

SEQ ID NO: 389574 - DNA, 379 bp, Homo sapiens
gcccaggttgtctcaaactactgggttcaagcaatcctcccaccttggcctcccaaggtgttgggattacaggcgtgagccgctgcacttggccctaaatgttttaaagtggttaatttgaagttctttctgtgaaagaaatgaaatagtgtaagctactcaaattgtttctgaatgcagatgaatgtaaaggttaaatttcattaatgatactttcgactagtatagatcattattggaagttaatttagtcctttcatttccttaatctttttaaagatgccaacttttttctgtattttggaaaggcattgatggaacccaggtctactaagagcattgaatggatggttggactaaattgctcctcaggtccttt

SEQ ID NO: 389575 - DNA, 1454 bp, Homo sapiens
gacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389576 - DNA, 1030 bp, Homo sapiens
gacctgactgagcggaagtaggagctctcagaggctaagaaggtggagaccggagaagctgtgaggttgtgagtaaccccgtgggtctaagcgtgttggctgtgaggaacaaagctagggaataatctgctgggaagcgcgaggcatcacttccctaactgtaggagctcaaactcctgtgttcttccagtagacctgggagcgaagagaagcaagacattgctgtggaggcgaagtctccgtattaagatcttgctggttttttaagttttcttggcacatactagggcaaattcagactcttgtcgtgatacaagggtcgttggcgtgattttgctgcgactagagcaatttacgttcttgcaaatctgtcgcaaatttttgcaaatgtctgggctgctgatgctctgactcagcttctacagcagtggttcgcaattggctgcatatcagaatcacctgggatgaaaacataaataaataaataaataaacctgatgcccttgcttgacgcgacactaataaatcagaatttggtcagggtctgagcagtggtattttctaaagtatctctagtgttctcttgggcagctagggttcagagtcacgctttctaatgcctgactctggcccccacggtaatcctgattagggtcacctgcgccagggttccccttccagtgtaagctgagtgggctctaccacacgcatttgggttaaagtgatcacaattttggcacggattttattttgaagtctactagaaacgtattcttgggcttcctgtggtggtgctaaaaagacggaccgtagtttcttactcgtgccttggttattcattctgaatggagattagggctgcttcctttttcttggcactgttttagtttctgcctaatttttgctatccaaacagaacacgaacggtggaacgtggaagagttacattaaaaacggcttcttttgttgcttttaagaagttctgggccaggcgcggtggcaggcgcctgtaatcccagctactcgggag

SEQ ID NO: 389577 - DNA, 325 bp, Homo sapiens
tcctggcaaggtggaaatcaggacaagaaagaaatggccatcaatgactgcagcgaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389578 - DNA, 170 bp, Homo sapiens
gcggccgcctactactactactactgctcgaattcaagcttctaacgatgtacggggacatgattgatgacgggttcccgcctgctgtcccctccctgatcacacagctaacgaggctgcctccagcatttcctgatttcctctgtggtaataaaagctttctgtgctta

SEQ ID NO: 389579 - DNA, 1435 bp, Homo sapiens
ctgctcagacggcgttgactcggcacgaggacggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389580 - DNA, 1400 bp, Homo sapiens
gacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389581 - DNA, 1200 bp, Homo sapiens
gacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389582 - DNA, 1095 bp, Homo sapiens
gacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtaatccatctcgtttctttttcaagtagaggggtgagctctgggtgcggctcctcataataggccgccactgtctccaggtagccccctttgaagtcgtcctccagctctaccaggctcgatttcacctgtccaggtcctgattaccaccttgccaggtac

SEQ ID NO: 389583 - DNA, 884 bp, Homo sapiens
gctcagtggtcccctggcaggtggaaatcaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389584 - DNA, 595 bp, Homo sapiens
gaattcgcggtccgcgtcgacacggtgcgagtaagacgacagaaggggatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389585 - DNA, 1808 bp, Homo sapiens
gacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgcttaaaaaaaaaaaaaaaaaaaaaatttttcgggggggctcggccccgaaaaatttttaaaacaacttcgttgggggcgggggcccaagttatatgcacctgggcccaaagcggctccagagaaccggccatgactggcgtgcgttcccccataaaaacccggcgcacgcctttgaacacaaccgagggcgtcgggcatacgggtctcacggggccaggacatcaccccgcccgtgcagaagagaaagaaacaaaggatacacaacacatacaaggcacaaagaaagcaaaagaagaaaagacagaaaaacaaagacagaggacagaggacaaacagaaagaacacaactccgacaca

SEQ ID NO: 389586 - DNA, 1432 bp, Homo sapiens
cggtctccaccttcttagcctctgagagcggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389587 - DNA, 1432 bp, Homo sapiens
ttttaaattcgatccaggggcacgcgtttagcatgttacatttcttgccctgtggccttccctactctgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389588 - DNA, 1154 bp, Homo sapiens
actgttcctttaaagagagaagaaaagaagaaatgatttttactgcgccagacttaatagactgttaccatcttttaactcaaaaccttcatcctatgaatggaaaacagtgcttctgagatcctgtggaatatagtagtatcaggaataaaatcaaaatgaccattcatcctttctcttatcctcagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389589 - DNA, 790 bp, Homo sapiens
gaaagcttttattaccacagaggaaatcaggaaatgctggaggagcctcgttagctgtgtgatcagggaggggacagcaggcgggaaccgtcatcaatacatcaagcaagagaagcttgtagcagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 389590 - DNA, 2550 bp, Homo sapiens
gggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacattaagagt

SEQ ID NO: 389591 - DNA, 2501 bp, Homo sapiens
gggtagctgcctgctcagaacccacaaagcctgcccctcatcccaggcagagagcaacccagctctttccccagacactgagagctggtggtgcctgctgtcccagggagagttgcatcgccctccacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacattaagagt

SEQ ID NO: 389592 - DNA, 428 bp, Homo sapiens
cagaaaattctgcctccagaaatacaaatatgctcttttctaaacaagtgacaacacaatgtagccataggctcccttaagcagccacctcatgtcaactaatagtctttgctctctagcctctctcctccaaagtccatttcgtctcctgaggcttcagctattactgtcagaccctcagttacttctgatgaacagggattaggcttgagaaaatggagatgcatttagattggcagatatgggggacttcttaatgtgcttttattgctgccttatctctgaaaacaggttctgggagtttgggaataagtctgagggcatataaaggattgagactgagtgacttaggagtgtgagaggaaatatcttgatgttgagaacagggttgatgtggaggggtattctctgtgttatgcatgtaaaaa

SEQ ID NO: 389593 - DNA, 463 bp, Homo sapiens
ttctggaagctgagtaggaatggtaggttatgacatgtcagcatctaatatgtataccttcgtttagtactcattttcagtgtaagcctttattgcctgtcaaaggctttattgcccgtcctcaactgtacctggtgtcaccaggcctttctggttcagttcttctagaaagtaaacacatattcctctggagaggtgtgggaaagtctgttaactagctcattgagctgggagaggagatccttgggattgaattactcctatttttatttgcaccccgtctcctagccttcagagattctgggtgtctccagttcctttttggaattctttttgtgctatgagttgggctgaatgctcggtgctgtgcctgcccaccttatccgtagctttaagctttccttctcaacctcagtcgcatgcttgtcagcttgggccagatcattctttgttgaatggggct

SEQ ID NO: 389594 - DNA, 154 bp, Homo sapiens
gatactgtaacctttctgtcccagcctcaagccctggagtcagctgtttctccaaggagcccagcttccttttagtgggaaatactagaagtaaacatctgggactcctgtatgctcactgctgctattgctactgtggagtcttctgcccttt

SEQ ID NO: 389595 - DNA, 278 bp, Homo sapiens
ccgaggctggagaattgcttgagcccaggaggatgaggctgcagtgagccaagatcgcaccactgcactccagcttgggtaacagagtgagaccctgtttcaaaacagacaaataaaaacaacggattaaaggtaatatgttttaagttcctagtctgtttagacattcaaaaaatgttggctgatgtaaccaattaagtagacgtgtggttctcacctctggaaaattctagtaatccttttgtgggcaacttctatcagtctctcttatctctgct

SEQ ID NO: 389596 - DNA, 326 bp, Homo sapiens
gctccttccttctcttgcttccttcagtcaacttccctggtcttattaagtgatgtcaagttctagcttgatttagacaaacagacaaataataaccccaactcagaatctatctgaaaggcctacactgaccaaatggctctatggcacctttaaatccagtcccttggggccactgggattgatgctctcctctttgctctcccacagagcacactagaacaagccagtgaagctgagtaaactgagccacttcccccaaatgacatccatgagtgtccctgagccctggggttctgccatcaggtgtaaggggaagcgaagca

SEQ ID NO: 389597 - DNA, 726 bp, Homo sapiens
cttagaaaaacagactggagatcatctaaaactctgaagacagatgaagggactaccttttccccgttttgtgttcttctcaactttgttgaaaatcagcaggctgtaaatgtgtggatctatttctgggttccctattctgttccgtggctccatatgtctgcttttcggagtatgatgctggaattgatgaagctgaactagaaggagtaaatatcttcactttaacaaaataaaatagcttctactttctttatgattattatatcaaaatataagcattattttaacttaattcagtaatcgttatatttcaaaaataaatctatttaataatataattattcatcattataacaaatgtttaaattatatgtatagatttgaggctgttaaggtcatgatgacaattttatcctatacattttatagcaaataaatatccatatatgcagcaaaacaatattaaatctatcaaagcatgtggttcctttatagaatcataaacatcaagttttattctaatttagttgaggctagtttatgaggcaaataaatacttgaattttttaaatttaaattttgctaatttattataatttatcagttatagtattttgctgaaaaattataattgtacatacttatgaagtacaatgtgctgttttaagcatgcattaatgttgcttttaaatttcacctattaaacagtttttgaaatagagt

SEQ ID NO: 389598 - DNA, 688 bp, Homo sapiens
agcagaagaaaagattaaagatcctacggggaaggagtttccaagctgcaggttgttaccaccattcgttacaaacataaagtaggccagaatggcacgtaattgagcaagaaatactagcgtgatattaaagagagtaaagagaactataatttcataaaactgtggtttcagttttgagggcagagtcatagtatggagcatatttattactgtgagtctcagtgaccagtgtttgggaacagtgcggtaggtgtctgcaggaagcagagaaagcaaattaagaagacagttgaatatgttaccttacatggacaatgaacaatatcataatagagtgttctttaataataaagctttgattaaacttgtttcaatgttactcgaaagtttaagattatatatatatacacatatatatgtatatatgaacaaagagttaaaacaaaaataacaaaacataacactgcttatggatacatactagacatggaagaaagaagctataatgtccatgtgtttatgtgaatgaatgcatgtgtttgtgtctgcccatgaaatactacccatctaaaagaagaattagattgtcctttacaagtagcaacctgacactgaatacagtggtaaggcaagttatatggacttgtgatttggtctcatggctatatgagtctcattgaatatg

SEQ ID NO: 389599 - DNA, 283 bp, Homo sapiens
gaactcatgaattagacaaatagcagcattgtatcttctttttctgggcctgattttgaggtatactgcacttcctaagggtgatttcagagctagcttgcaggtggagctccacctgctgatacttgtgagggatagctcagtaagcactccttcagctagcatgtttcccactaacattcacactgatactccagcctagagaaagacctttgggttacaccagtctccagaaagccttcatttaaatgcaactagggagaggcgtggtggctcaccacct

SEQ ID NO: 389600 - DNA, 324 bp, Homo sapiens
gagaaaggcgtggccttccttttcgcagtttaatgcctttacctttcctttgggtcctgctaccccttactccatcagtggtcgccccatctcctgttgagcagtagatttttaagccactcatcatagtgaaccctgtgggccctttattgaaactgtctgtttggttcctgtgccactagactctggctccggccttccccacagctgtggctcctgaacctctgccgcccctagattccgcccctttcttggcaacagctgtcatctttccaagggcgacttctcagtcctctcatttatctaacacgtgaatgtggcgct

SEQ ID NO: 389601 - DNA, 758 bp, Homo sapiens
gtttaaaacatagttgtaatagtggagacgattgttgatccagtcatctggcattttgtcagctggaaagctgtttcctggcctttcagtccctcagtacaacagggattgatggcttttggtgttggagcccagtgctgcagggtcctctggtggcctctgagtgagcaaagaaaggcttacgtcatgctcagcaagatacatttagaagcacttgtcatagtgctgagtgtgttttctgcagctttgaatgttggggctcctcacgtggcatatagagagaattctttgttaactgttatgtttgattttctagaccaccatattccccagttatccttgataacagagcatttgctctggcagttacaataatttttgtcagtgcacagaatgccttttaaatagtgacttgctggttttctctacagctcataagtctatagagaaccttgtgttcatacctttctcttctgcccagcagatggctgtctgagtcatactagtattacaagactaccagcggaggctgggtgcagtggctcacgcctgtaatcccagcactttgggaggcccaagtaggcagatcacttgaggccaggattttgagaccagcctggccaacatggtgaaaccccgtctctactaaaaatacgaaaattaaccagtcatagtagcacatgcctgtaatcccagctactctggaggctgaggcacgagaatcgcttgaacccaggaggcggaggctgcagtgagca

SEQ ID NO: 389602 - DNA, 349 bp, Homo sapiens
catgcctgtcgccttttctgcgcccccatcctgtcggccactctccgcaggccttacctgttagtgcctgttttccttgcaatgcaggtctggagtcggccctgagtgtgttccctagttggcccccttactgcctgggtgaccttgggtggtctgcttcaccttgagtctcctggtgtcaagcgtgagagaatgagtccaggtgcccagcatggaagctgtcccacggtgtcagctccttctctttggcccccactcccccattttcccaaagtgtgtttctcatctttctcaccctcatggggctgcttccttcctgggcatcttatctcgcacctcctccttttgt

SEQ ID NO: 389603 - DNA, 456 bp, Homo sapiens
accattgaacccaaatgagctgaatctaacacaagaatgaaatcaggcctggcacagtggctcatgcctgtaatcgcagcactttgggaagccgaggtgggcagatcacttaaggccaggagtttgagaccagcctgaccaacatggcaaaactgcatctctactaaaaatacaaaaattagccaggcgtggtgatgtccacctgtaatcccagctactcgggaagctgaggcatgagaatcacttgaatccaggaggcagaggttgcagtgagccgagatcatgccactgcactccagcctgggcaacagagagagtctgtctcaggaaaaaaaaaaaaaaagataaataaatacaggtctaagaaaccgcatgtacaaagttggagggttaggtagagggttcttgctactaaagtgtaagtggaagataagagattgtttagtaaaaaagtta

SEQ ID NO: 389604 - DNA, 631 bp, Homo sapiens
gtgctttcctgagttctgtgagcctttctagcaaattattgaacttgaggagggggtcgtgggaactcccaatttattagccaggtcagtcagaggtacaggtggcaccctggggcttttgactggtatctgaagcaggggcaatcttatgggactgagatcttaacctgtggggtctgcactaactccaggcatttagtgtccgtatgaattgaattgaaggacaccaagttggtgtccagagaaatggagaagtggttggtatgaggaaaaaaaccccacaaacttggtgtcagaagtgtgagtaaaaacagtttacaaggtatgaacataaagaaactaactccagatcctgaactcttgaaaactatgctttttggcttttactcctacttttccccctgaaaattgaggctcagagaagtcaagtaacttccccaatgtcacacagtgagtatcccctggaacactaatgcctggactaagcaagtgctcagtaagtatctgttgaatgaatgaacgtgtcagtggtcaagtcagggctggaacttgggtctgtcagattttaaagcctactcccttacccactatactggcacactgtaagaatctaatagatctattggtcttt

SEQ ID NO: 389605 - DNA, 328 bp, Homo sapiens
gggaagtctagaatgatctcggtcataatgagtcagaatgtatatatacaaccattcctttcagctacgatacaacagaagcaaatatttgccactggaaaaaatattcaaagacactcttaggttaatctatagctgatgacagtcagtctagtctacatagcaagcagcttcaagatatgattacttagctaagcgggaaatgggacgtgactgctgcctcattcccacgcctctctggacctgataatttagaggaagctcacattcgcaagataaaaattttcttttctttctcagtattaaatatgctgtcacagtagaagaa

SEQ ID NO: 389606 - DNA, 263 bp, Homo sapiens
ggtgaggtaagaagggggagcaaagctagaaacagggaaacccatgacagggaaactgcacttttcaaagtaacacatgaaggtggtttgaatggagatggaaattggtgaaatggtgtgaagtagtcagatcctgaatatactttacaggtagagtcaacagaacatgttggaggatcagttattccttttctctctgttgtttctagtgtttccttcattccttaaagctaggcaagattatgtccttacgggtttcacat

SEQ ID NO: 389607 - DNA, 786 bp, Homo sapiens
gtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389608 - DNA, 1558 bp, Homo sapiens
gtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaaaaacaaaaaaaaaaaaacaaaaaaaaaaaaaaaaaaaaaaaaaaaaaaaaaaaaaaaaaaaaaaaaaaaaaaaaaaaagaaaaaaaaaaaaaaaaaaaaaaaaaacaacacgaaaaaacaaagagaagcggagcggcccgcgcagccagataaacggacgcggagagacgacacagcgaagagacgcagcacaccccgccccgaccacagcgcgcagccaacggaggagagagactgatatcgcaccagcgcacggccgccgagcacaacacgagacagacgagcagcgacgacgcagtgagaataactgcggcggaaagcacactcactactgcgggtgcaggatcaaacgacaagacaaccacacaatcgagacagagagagagacaagatcaccaaccagatagccgcgcgagtaacagaatcatactagggggagagacgaacaccaccgagtgagcgaataatgagccgcgcacaaagcacaatacggagagacgaacaaagaaccagaacacgagagaacagaagagaaggagaagcaggagaggacgacgagaacggacagacagaaggcgacagagagcgaatgcggaagacactagagcgtacgagcctgacatcttgaggatccggcacccccacacggcacaaagagaaagcgaggcaaaaggaaagaagaagacagagaagacagagaggagcaaggagagagaaaagagcgagaagaggagacaaacgagcacgaaagaacacggaaagaaggcagaaa

SEQ ID NO: 389609 - DNA, 699 bp, Homo sapiens
gtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389610 - DNA, 459 bp, Homo sapiens
gcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389611 - DNA, 1503 bp, Homo sapiens
aacgatggtctcagctcagatggtcctcagctcaacgatggtcctcagctcaacgatggtcctcagctcaacgatggtcctcagcccaacgatggtcctcagctcaacgatggtcctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggaccatccagactcccaggtaaccccgaatactcttttttcaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389612 - DNA, 1601 bp, Homo sapiens
aacgatggtctcagctcagatggtcctcagctcaacgatggtcctcagctcaacgatggtcctcagctcaacgatggtcctcagcccaacgatggtcctcagctcaacgatggtcctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggaccatccagactcccaggtaaccccgaatactcttttttcaggctacagcaggagctgatgaccctcatgatgtctggcgataaagggatttctgccttccctgaatcagacaaccttttcaaatgggtagggaccatccatggagcagctggaacaagaaactcaagattctagcaagccccttgtgtggggcttgggttgggacatgaggctgctgctggagcttactctgcaactgtttctccaaatgccaggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389613 - DNA, 581 bp, Homo sapiens
gtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacaaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389614 - DNA, 1156 bp, Homo sapiens
aacgatggtctcagctcagatggtcctcagctcaacgatggtcctcagctcaacgatggtcctcagctcaacgatggtcctcagcccaacgatggtcctcagctcaacgatggtcctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggaccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacatccatttcttccagcagtccctcctcccaattccatccccccacacgaagttatctcgaacacttccctgaagtcaaacaagaccctccctatccagtgtgtccctacttccta

SEQ ID NO: 389615 - DNA, 1344 bp, Homo sapiens
ttgtctgattcagggaaggtccctacccatttgaaaaggttgtctgattcaggaaggcagaaatccctttatcgccagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtataataagtaaagtcatagtccttttaccagttaagccctcggtttgagaccccttttgttattattcaacattcactgtgcgatttgtgtccccttttttaagaccaagaacaacaagacaaaaactcgagagggaccactacatagtgagacgggaagccagagaacaaagagacgattcaagcgaacactggcgcccacaaggggccaaaaagacgggataccagagacaccccacaacagaaatagcgtagtgcaaccacaaacattgggcggtacaccacatcttgagcccgggaacactacccaccagaactaagagagaggaccgcaacatataacagatcgaccgaaacaacccagagggtatacacctcgcaattaaaggaaagagcgcgaacaacgaaagaacgaacacacgagacacggagacgaacagacgacgaaggaacgacagagaacgaaggaagagcggcgaaacagacacataaggacaaaaaaaaaaaaaggcacagcacaagaacaagcgaagagagacacaaatagacaacagaggacgaagcaaagaatacgacacaaacacaacaaccaagaacagcaataatgctgctcgagtacaaaaaagcatacacaagacgagaagcagagaaaacgagaagagcaacaagaacagaacaagaaccaacaaacaggaagaacagaacagagacaaacacaagaaaggaaagaagagaaagaagaaagacaaagcgagcacaagagaacagagacgtcgagaacgagctgcacca

SEQ ID NO: 389616 - DNA, 1357 bp, Homo sapiens
aacgatggtctcagctcagatggtcctcagctcaacgatggtcctcagctcaacgatggtcctcagctcaacgatggtcctcagcccaacgatggtcctcagctcaacgatggtcctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389617 - DNA, 683 bp, Homo sapiens
cacgaggtttttttttaaaaaaggacaaaaatgcatttatttaatatacaagggctcaaccgaggcttaatttaaaagacaaaaacaaaacaaaaataccacagctcaagataaagagtcctatacagaaatcacaaaaaggacagaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389618 - DNA, 571 bp, Homo sapiens
aacgatggtctcagctcagatggtcctcagctcaacgatggtcctcagctcaacgatggtcctcagctcaacgatggtcctcagcccaacgatggtcctcagctcaacgatggtcctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttagacaa

SEQ ID NO: 389619 - DNA, 248 bp, Homo sapiens
acccagggtaacatatgcctggacatcctgaaggaaaagtggtctgccctgtatgatgtcaggaccattctgctctccatccagagccttctaggaggtgactttagagaccacccctcccctccatgcaacttgggaacctgtcaggactccctggggtcagcctcttctaccgccttgaccttctctttctctccacccacagaacccaacattgatagtcccttgaacacacatgctgccgagct

SEQ ID NO: 389620 - DNA, 159 bp, Homo sapiens
atctaccaacctgatggatttttgtgagaattaatgaataaaatatacaaaatggttatgtcaggccagtggcaatcaataaatgctagttttcttttttcttcttttcctttcagattaaaatttaattggttttagcttaaattcagggtgaaaatg

SEQ ID NO: 389621 - DNA, 132 bp, Homo sapiens
agcgcaggtcccgacagaggtcgccgggtggtggcgtcagctgcggcgccctccgcgtggaaattagccggttgcccgggcaaatcagggaggaagggagggagctgaacacggaagtggtggcggcgccca

SEQ ID NO: 389622 - DNA, 430 bp, Homo sapiens
cttttccagcccttagtgacaaatgttttatctttatggaaggcacagggaaactgcaaatcaacaatttgtcctgaacttgatcatttctgtccagtcttattttcagaaaagataagattcatcaatgtgtatattagcacttttatgttttatgataacatgcagtatattcagtataaaactcaaatgtatattatacctttatcatttctacaatttagtagttaaaaataacttcacccacccacaaattttctgacaaaatatgattgctctatattctgttatacacctgtggctcatttggaatattcatcagctgagaagattaaaactacgattacttcaaatagaaggtgaaaatctcgcttggttctaataaagcacctataatgtccttcaaatctgtagttataaacaagcttga

SEQ ID NO: 389623 - DNA, 316 bp, Homo sapiens
cataatactcctgccatctataattaaatggaaggggttacaactgttgaaacttgttaaaactgaagttgtcctaccatgtattaatataccagggataggaagatgtttacagttggcacagtgttagagaagtcctggaaaggcaagagagagaaaaattaaaataataatataaaacagaggtggggtaaactatggtctgtggccaaatctggcctgctaactagttttccaattaacattttattggaataaaagcaactggagcaggcatgctgatctatctatgtgttgtctatagctgtttttaaaa

SEQ ID NO: 389624 - DNA, 326 bp, Homo sapiens
ctggagctctgaggagaggtctgagctagagacataagcctggcagaaagagagactccggaaggcaaaaggagcaagacacaggtataaacacacactcgtcagagccacaaagccaagaaccacacacacacaaaagggacggagccggtcaaaaagatgcacaaacagggaaagtcagatgaacagagacagactttcatgaagcaatcgcttgtggcttttctgggtatggaagaaatatatttttcaagctaagttgcagtttgacaattccaggcagaaataaggtgagcacttggccagagtccaccctcccttgctgg

SEQ ID NO: 389625 - DNA, 158 bp, Homo sapiens
taatgtgtgtcaaatttgggatatttagaaattagtttcactgcttaatttattaccttaattgagtggttttaagttgtgccttgatttgccaaccatatgtgttaagaaaccgctcagtgctaagcacattcctgaattcctcatttctctcaatc

SEQ ID NO: 389626 - DNA, 211 bp, Homo sapiens
attagaatataagttatggagaaaaaaattttcagcacaaaactaaatcataaaaaatgtattttactacataaaattttaaaacagcacacccagttattaggcaactgaaaatcaaaagaaaaacctctgtaacacatgacagcattagcatctttataaagaatcagtcaaggccaggagcggtggctcaagcctgtaaccccagcac

SEQ ID NO: 389627 - DNA, 313 bp, Homo sapiens
ctgctcacctcggcctcccaaagtgctgggattacaggcatgagcaaaaccagcttttctagtgctgacttcaggcttccagagcaggcatagaaagtgctcttaactgtccagctctatgaaagtgagagcatcttccttcccaattccagttctctgtcctgaatgaaaagaggcaggagggccactgagggattgctcatactcacctggacaggacttctgttcctatagttgcaccattttctctattgccttcttggtctttatgttagccagagccaggccttttcttaaattctgtatctccaga

SEQ ID NO: 389628 - DNA, 769 bp, Homo sapiens
atgttgccactttgatcacaggattttggtcagaaagaatgtgggatttggactttgagtttggctcttgactgtcacctgttcagtgtgtgaccttgggtaagtttctttaccctctgagccttcgtttcctcatctgtatagtgggaatgtgcaatctggagtctgtgctaggattccgtcacatctagtggactagcagggaaaccctacagggatctgggaaaactcccttcttgaggaaatgcagggagctgcgcacagtgggctcaccaaaaggtgaagcatcatactggagaaaggagtagttttgagtacactgtggtaacaggggcggaaccccatccttcaccctaccccatatcagaccctgtctcattcctgggcagagttgtcactaaaagctaaagggactatttgttagtgcttcataagacactggagtacagggtcactgagatgaaactcctataaatgaacataagagagaaaaaggcaacttttccacctgacaatccacagagcaactttaccagagtgagatggcagagcagagtaagggacagtgcctgggcattgatttgctgatgagcacatgtaagacctcctaccccaggaactccccaaaagtgcagggtagaaggtgctttgcagggagctaggttcaaagtgagaaatggtggtaacaaactaacatttagattattagtcttgatgtgactttatttgtgcatgcgtagtgtatcacacagggttctctagagaaaca

SEQ ID NO: 389629 - DNA, 455 bp, Homo sapiens
atatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttga

SEQ ID NO: 389630 - DNA, 267 bp, Homo sapiens
ctctcagcggcagcgcagcaggatgggaggagaaagagttttgcttgcacaagcagcagtagactcctcagtatggagacagaagcctgaggaagaaaggctttttcttcttttctgggccaggttgtctatcataacaatgtttgcaagcccctggatgaatgaaggcatggctggtacccacagagcagctcactttactttcctgacattcttaccaccccagagcatgtataagaacagggttggcagcaccagtcatgaggg

SEQ ID NO: 389631 - DNA, 508 bp, Homo sapiens
gggcatggaggtagaagtcaggtagagggaatggcttgagtgagggcatggaggtagaagaatgcatggtataaagattttggggagaaagttttcataattcaagtgctacttctgtcttttttgtttgtttgtttgccaaatctgtatatcacttataatttacttaacctatttctttgagatggctcacttcattttatttaacaagttaattgaaaaaggaaactttacaacagtacactaaatagaaaacaattcaatagaaagtaatagtaaaaaataaactcaattaaaaaaaggtattattaaattttagctagatattgcagttggctcaaaacctgaggcctgctctctctttgttaagagtgatgtttctttagccgggtactgtggttcacgcctgtaatcccagcactgtgggaggccgaggtaagaggattgcttgaggtcaggagttcaagaccagcctgggcaacatagtgagacccccatctctatttaa

SEQ ID NO: 389632 - DNA, 248 bp, Homo sapiens
aagcagcaacataaatcagtaaattgtacagggcgttacaccgcgactgagtgctctgggggaaacattcgctaaggggaacgggtactaggttcgtagttttaaataaggtggtctggcaggcctcatcaagagaggtaatttgagagaagactctaaggagaaggaggaatcggccctgtggctctccaggaagagcactgcaggcaggacaggcggccagtgcgtgcaaaggcccaaggcagtag

SEQ ID NO: 389633 - DNA, 751 bp, Homo sapiens
gtattcagaccataaatcagtaaaaaaagattcataaaagtgagtaaaagataaaaataggcattttgcagagggggtaatataaattgctcataatttttttaatgcttaagcttaatactaattagcaaactgcaaattaaaaccaaaacccaattccaaaacataatgacctgattgcaaaaagtattaaaagcacattagtatttgttcaatactagtgtgctgggatgattttaatgataagaaacactttatttttcttaaaataatttagcatgggtctgctttgtgaccaagcaaattcataatcatgtacgtagactatagtaacactttcacatttgtaccaagagacttttacaatattctattcttatcaaaactgtttataatagtaaaaaattggaaaccactcaaataagccattaaaagggtctggctgctgggcacagtggctcaagcctgtaatcccagcactttggaaggctgaggcgaaaggattgcttaagcccaggaattgaagaccagcctgggaaaaatagcaaggtgctaaatatatatatgcaagctgggcatgctggtatgtgcctgtggtcccagctacatgggagactggggtagaaggattgcttcagcccagaagattgaggctgcagtgagctgtgtttgggccgctgtatgccagcctaggcaacagagcaagactgtcaaaaaaaaaaaaaagtggactagttatacattcaaatac

SEQ ID NO: 389634 - DNA, 913 bp, Homo sapiens
taatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattattgc

SEQ ID NO: 389635 - DNA, 190 bp, Homo sapiens
cagtgccccatccagcataccaaactcaccgtgtgtgaggaacagcagagggaagcctgtgctgttgtcctgcaggtgaatgagtgaaaatcatctgatctcacaggtagtgctgccccattgactgaaaatgtctccagtagtgtgttcctggcattccactttgaagatgttggcaatcataaatgcc

SEQ ID NO: 389636 - DNA, 648 bp, Homo sapiens
agctcctcagcacaggacctgaggtggtgagctgggaggaaacccaccagacgtgctcttcttcctgaggtgcttagagtcaggttccacagtttcaagcatggccaacctccaccttcccctctctcagcccatccacctgattctcctttgctgttggttgaagagctcagacaaaagaccaaggctgtggctccagttccagcactgcctctccctgtgcattagaccctaagtgaatttcttaacttggctgagcctctattttcccatctgtacagtggggataatacccttctccacagagttgttgagaggatccactcgaatgtaaattatgaaaaagagctgtcctttccaaaaagccaaaagaagactgttggaggaggaggtgggcgatactcttctccttcgacaggtgaatatattatggggagacgtttctaggtggagctggaagcccggtctgaactcagtcactattcttattagatcaggtgagaagatcacacaggattcagatggctccgaggtgacaagctcaggaataatcccagcttcactgttagaaactgcattttctgggtcttaagacatggaaatctccatccaatgaggatgtagatcattgaacagatgtacaccctc

SEQ ID NO: 389637 - DNA, 306 bp, Homo sapiens
atagtttactctgcattaaatctattgtgatacgttcttctggttgaggtaaatgaaaaaaaaccttgtttcacacatatgtgtagtactactttgatcactttggatcattgtggatactcctccttaataccacacgaaaactgacttttcatagttttggccaaaacaggtagtagttttctaaaggttcgctgcagagcagaatctgaaactttaccattaaactttttgtaccctgctacattaaaatccatttgtctgtcttgtactttgaatgactcttttactcatgcatgcttttgt

SEQ ID NO: 389638 - DNA, 331 bp, Homo sapiens
actactactactaaattcgcggccgcgtcgacagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatat

SEQ ID NO: 389639 - DNA, 1860 bp, Homo sapiens
tagggcggtcgcgtaattcggcacgagggcgcctcacgtatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcaaatgagggtgacgggactggggcgccggggagcccacggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactag

SEQ ID NO: 389640 - DNA, 377 bp, Homo sapiens
gcgcctcacgtatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccagctatgcccagggtccctcaaagtgctggaggggctgtgacttggtggggagtgggtctgtcacagccatcctctgtccagggtggggcaaggcctgggacagtgccaggcaccccaggaccccttccaggcttgtctcctgctccaccgcctcaacaccccccaccc

SEQ ID NO: 389641 - DNA, 770 bp, Homo sapiens
gagatgccagctatttggactcagctctgtagatgaatgacagaaatagactaggtgctaatttgcatgtagcttcacatgcgatttgcatagggcttgcttaatgctcagttgcaccagaagcctcattgcatctccattgccatctggctcctcccccagggagtcataactcgggtcatgcccagcctgggggcctgagagctaaactcagccaaggtgttagatactgggcagaggaggccagcagctcttgtgggctttgctgggctctgacagctcgaggttttaatcttgtgtcagagcagcttaggctgggctgctagtgtggggaagaggggaggggacttacactccagggccaagcctctctgatcctatccccaggccctggatgcttcctgccagattccatccaccccagggaggggtggccacctctccatgtcactcaataaggtagggacccaaacactgggtgttgaccagcactggccccagcttggctggtgctctgggagaaccagggcagagaggactgggctgggcctctgcttccttcaggggacagaaccacttttagaagggagacgtattttggcttggcatggtggctcacgcgtgtaatcctagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatac

SEQ ID NO: 389642 - DNA, 1787 bp, Homo sapiens
tagggcggtcgcgtaattcggcacgagggcgcctcacgtatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcaaatgagggtgacgggactggggcgccggggagcccacggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatat

SEQ ID NO: 389643 - DNA, 1307 bp, Homo sapiens
tagggcggtcgcgtaattcggcacgagggcgcctcacgtatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcaaatgagggtgacgggactggggcgccggggagcccacggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatac

SEQ ID NO: 389644 - DNA, 624 bp, Homo sapiens
gaaccagagactcaaatgcagctttccttatttctctttctttcatctctgcttctctcagagtattagctcattttccctctgcagacttactctctcatgcacattatgtgaaacatgattgctaagcatgcctgggttatacatctcccaacaatcaagagaaactctctctagcacatttagtgagaaaaaccttggaaaaattctctggtccaggttgggccaagtgcccaattctgaacaaatcaaccaaggccaaggggcaggacccctagtttggttccagtgccttctctggactgatctcgggatggaaaaaattggctcttaggagaactataattgagaaaagcagttcacagaaaaaagagggatgctttttccagaaaagaatgtggggggcaggcaatatagtaattgcatgtattcaaaggttagctcaatcagaaatattagagaaatgaatcttatgttggtgggaatttgaactggaagaacttgaagttctttccaactcagagatgatgtgattctagctgtttttcaggtaaggcaggcacatattggtttatactaggaattttctttttccacgtatttctactcaaggattactctgtt

SEQ ID NO: 389645 - DNA, 318 bp, Homo sapiens
cttcattttaagtcaaatgagagaaacagacaagacaagtgtcagtgttgatgccacatgaccaaagccatgtcaagtataaacattttatgtaaaatgtagctattttaggacacagggaaagagtgacttttccgcacttaaagggcctggtaaggatttctaaatgaagtggttcttgaaataagtcttcatggatgataaggctaattacccagataaagaaagggggaatgcattctggacatgtacctgccattgcattcacaaaggcaggcaagaaacagcaggtccaggcatgcaggacaagtagttaag

SEQ ID NO: 389646 - DNA, 1370 bp, Homo sapiens
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389647 - DNA, 1532 bp, Homo sapiens
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389648 - DNA, 590 bp, Homo sapiens
gctatgtaccatccgaatgtctggcgagcctagtaagtcagtgaagatggtcactatgtgttgcctaagatatcctggtcacgactagtgttcgtgtcctcatcacctagataaaaggcccggggtgaactgaacgttctgaacaagatcctagatagtagtgtatggggtcattccttgaagtcttatcaagcgagtcattccgacagcctgagccgttccgatgattcagaacattagggccacttcgattccatggtcatgaagtgcaacaatgcacaatgcaaagtttggccacgaagttccggtcaccactccagtggagactccacactctcattcacccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgccctaaaaaaaacaaaatccacaaacaatc

SEQ ID NO: 389649 - DNA, 1674 bp, Homo sapiens
  misc_feature (171)..(171): n is a, c, g, or t
ctgctgatcctgaaattgtaccagcggcaagatgtggcctggaaggggactttaagttctccacaactgccagcaatccttccaccaggcaaaacacatcatctaaggaaaagaagtgaggtcggaacaccaacgcatcatctcactgcatggccctggaggctctgcgtnttaaagaccccagaaccttccccattcaaggtcctctcctgggcacaggagattggagaaagctcctcccttaattccagggaccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389650 - DNA, 1273 bp, Homo sapiens
  misc_feature (97)..(97): n is a, c, g, or t
aaagaaatgagacaaaggacttagagccccgaattaataccaataaagtccttctttattgcttattttcctatatttttttctcccggaacctctnctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389651 - DNA, 1224 bp, Homo sapiens
cttatgctgagcaggtctacctgggaaagagaaagtgtttgctgtcaccaggaactctgctgggcctagggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389652 - DNA, 973 bp, Homo sapiens
  misc_feature (722)..(722): n is a, c, g, or t
  misc_feature (732)..(732): n is a, c, g, or t
  misc_feature (740)..(740): n is a, c, g, or t
  misc_feature (744)..(744): n is a, c, g, or t
  misc_feature (755)..(755): n is a, c, g, or t
  misc_feature (757)..(757): n is a, c, g, or t
  misc_feature (765)..(765): n is a, c, g, or t
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaaaaaaaaaaaaaaaaaaaaaacaaaaaanaaaaaaaaanaaaaaaanaaanaaaaaaaaaananaaaaaaanggggggggcgccgacaaagcatcccccgcgggggcggacacaggagtgagtgggagcgacaccgatctgttggaagaagaggggcgcccagaaagcgcgggccgatgtagaagcagagagcaggggcggacgcagataagacgcgccgggagcgggacaaacgacggcacgcggcgactctgaggaggacgaccctcggcgcggggaa

SEQ ID NO: 389653 - DNA, 895 bp, Homo sapiens
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaaaaaaaaaaaaaaaaaaaaaacctttttgggggcgcatgtggggccttgagaaaaggttttttaaacacattgggtttggggccggggggccccagttgtggttatgtgtgacactgtggccacagggggtccacaagggaacccccgggcacagagaaatggggcttgggttctctcacccaaataaaaaaaagccgcgag

SEQ ID NO: 389654 - DNA, 1616 bp, Homo sapiens
tccctgcagggtagtgatctaaaattacattttcaataaagtctatttaagtgtataatagtgagtcattttcaatgatgtgcaaacaccagaccaggtgggtgtggacatggtggaagcgggaggatgggctttgagcatgattggacttggggaaacaggaatctgggaactgaaaccatctgtcgtcttgaccagaaaagtcccccgctgctgcaggaggcatggattaaccacgtgtctggaaacatgagaccaaatagtggctaaaaacctcctagattagaacccatttcaggtggcagaatgctggcgtgactcggaggtgtggggctgagtgggcgagtccacatttcctacgttgggatatgaggggatgaggtggctgctcagtgacaggacccctgtcccgcaggagaccctttcccaaggcccctgaaactccccaggccctgcccaaaggcttggctgaggccggcatcaccatctcccctccttcccctcttctcccactaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389655 - DNA, 1189 bp, Homo sapiens
aatggctgctcctgcttcgcgcttcctgcttctgctgcttcctgcttctgcccctcaccgtgaccctgggcctgcttgtgttcctgcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389656 - DNA, 1045 bp, Homo sapiens
catgcggtggggttctgtgcgccatgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389657 - DNA, 1010 bp, Homo sapiens
ggatttgctggtgcagtacaactaggcttaatagggacatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389658 - DNA, 1000 bp, Homo sapiens
gaattcactagtaatcactagtaatgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389659 - DNA, 1029 bp, Homo sapiens
tggtcttcaaagcatcatgggaaagatgaagtctgtacttgtcaaagtacctatcctcactatggctaattcccatgctgcaagatcttgaacgcaatgtaatcccattcagggagaatcagctctcatatcccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389660 - DNA, 921 bp, Homo sapiens
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctggatcttgctcccatcagtagtgacctgcgggacctttcgaaaatctccccagtaaagacattcttgctttcatacaacctggctgctggagcacctggctgaattttatcttattattcacctttgagttcgtggcaaatacttagcagtatttaatttttgctttctgatttaagtgtaatacgaaaaaaaatcatgcaaatcaattaccagtatctggtgtttgaaattgtaagatgctgaaaagaactgttaattatactctgtatctgccgggggcaatgtaaactgactttaggattcgaagagagccttgctgatg

SEQ ID NO: 389661 - DNA, 310 bp, Homo sapiens
cgcttttcagggtgaaagggctaactctcccagcaggagaggcctcggggctctgccctttagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaagaaccctctatccggagggagagggcaaatgggggcggacaccaatctcaccacttttgtctccttagtcaccatccaggggagactccacctctcatcaccc

SEQ ID NO: 389662 - DNA, 477 bp, Homo sapiens
ctgctgatcctgaaattgtaccagcggcaagatgtggcctggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatggtgctccatatatatttgtcaagagaatggggggacagatggagaggacacaggctggcactgagg

SEQ ID NO: 389663 - DNA, 1880 bp, Homo sapiens
  misc_feature (171)..(171): n is a, c, g, or t
ctgctgatcctgaaattgtaccagcggcaagatgtggcctggaaggggactttaagttctccacaactgccagcaatccttccaccaggcaaaacacatcatctaaggaaaagaagtgaggtcggaacaccaacgcatcatctcactgcatggccctggaggctctgcgtnttaaagaccccagaaccttccccattcaaggtcctctcctgggcacaggagattggagaaagctcctcccttaattccagggaccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacagaggctggggcgaggaggataccatctgtcagtcttggctggatgacatcatgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389664 - DNA, 1200 bp, Homo sapiens
tcgcaccaaggcttgttcaacccggggaaacaaaccaggcccacggcttcttgaactggcagaaaggggaacccctggggcctggcttgggttcctgcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389665 - DNA, 1242 bp, Homo sapiens
ccgacgttctgaactactgtcagacatgtgcatccttcgcgtcgtgtgatgatagttcctgcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389666 - DNA, 1878 bp, Homo sapiens
  misc_feature (171)..(171): n is a, c, g, or t
ctgctgatcctgaaattgtaccagcggcaagatgtggcctggaaggggactttaagttctccacaactgccagcaatccttccaccaggcaaaacacatcatctaaggaaaagaagtgaggtcggaacaccaacgcatcatctcactgcatggccctggaggctctgcgtnttaaagaccccagaaccttccccattcaaggtcctctcctgggcacaggagattggagaaagctcctcccttaattccagggaccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacagaggctggggcgaggaggataccatctgtcagtcttggctggatgacatcatgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccacccagggagactcacctctcattaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcaaaaaaaaaa

SEQ ID NO: 389667 - DNA, 287 bp, Homo sapiens
gggctggtaaccaggacagtggtaaatgtagtaggaccacaggtggctcctagcctaactctgggagaaaaggagttggacccagaggaggcacgccagaggaagtgatggttatcagagactgagggctaaagggattggccaggagatgagggtgtagaggggcccgagtagttgcagacaaaagtcccgcaacgagggaggcaaagtgtagagctcttggccgcctgcagtaccatggaacttgggtgctagtagagacaaatgtgttggagagggtaaaccag

SEQ ID NO: 389668 - DNA, 579 bp, Homo sapiens
  misc_feature (14)..(15): n is a, c, g, or t
  misc_feature (17)..(17): n is a, c, g, or t
atacgactcgagcnngnacccgtatgcgtgtaccaacactaaattcaagctgtcattaatgaataacaacatgaaattcaaactgtcattattgaataacaacagaggagattaaaactgttcccaacttgcagttattacaaatgtgctaacaaacacaatttgtgttccttgccccttctaccgtcttggaaaaaaaagcaggttttttttttttgggtttctgttgggtaacaaagaatttatgctcaccaagttatatgatcttttctctgcctaactcttaagtgtcctacctaccatccttgtgcaggcttcctgggtgatctccccatcttcaggacattctctgagcctactccccaggtctttctacaactcgggtttttcttctgggcaccagccctgaagacctagccacttagagggcctctttttctgtctgttctcttggcctcgtaagtccatcatgtcatgacacctctttatctctaacctctgaacacccaagccaaaacctaagccatcccctactctcagtctccccttgtacacgcatagggtacgagctcgagtcga

SEQ ID NO: 389669 - DNA, 590 bp, Homo sapiens
  misc_feature (14)..(15): n is a, c, g, or t
  misc_feature (17)..(17): n is a, c, g, or t
atacgactcgagcnngnacccgtatgcgtgtaccaacactaaattcaagctgtcattaatgaataacaacatgaaattcaaactgtcattattgaataacaacagaggagattaaaactgttcccaacttgcagttattacaaatgtgctaacaaacacaatttgtgttccttgccccttctaccgtcttggaaaaaaaagcaggttttttttttttgggtttctgttgggtaacaaagaatttatgctcaccaagttatatgatcttttctctgcctaactcttaagtgtcctacctaccatccttgtgcaggcttcctgggtgatctccccatcttcaggacattctctgagcctactccccaggtctttctacaactcgggtttttcttctgggcaccagccctgaagacctagccacttagagggcctctttttctgtctgttctcttggcctcgtaagtccatcatgtcatgacacctctttatctctaacctctgaacacccaagccaaaacctaagccatcccctactctcagtctccccttgtacacgcataagaggatcctgtagagtcaccgcagcaaga

SEQ ID NO: 389670 - DNA, 572 bp, Homo sapiens
  misc_feature (14)..(15): n is a, c, g, or t
  misc_feature (17)..(17): n is a, c, g, or t
atacgactcgagcnngnacccgtatgcgtgtaccaacactaaattcaagctgtcattaatgaataacaacatgaaattcaaactgtcattattgaataacaacagaggagattaaaactgttcccaacttgcagttattacaaatgtgctaacaaacacaatttgtgttccttgccccttctaccgtcttggaaaaaaaagcaggttttttttttttgggtttctgttgggtaacaaagaatttatgctcaccaagttatatgatcttttctctgcctaactcttaagtgtcctacctaccatccttgtgcaggcttcctgggtgatctccccatcttcaggacattctctgagcctactccccaggtctttctacaactcgggtttttcttctgggcaccagccctgaagacctagccacttagagggcctctttttctgtctgttctcttggcctcgtaagtccatcatgtcatgacacctctttatctctaacctctgaacacccaagccaaaacctaagccatcccctactctcagtctccccttggacacgagtgcctgctactttg

SEQ ID NO: 389671 - DNA, 405 bp, Homo sapiens
aaactcttattctttgatgcctatgacacagcttttctctgtgttgaattaattattaaattagtaatgactagttaatacagtctccacattgacatgaaatgtggttataattgagcaggcaaacttgagtctccaatagacattgctgtggaaaacaaagttgagatctagctaaaaccattggaactaacaggttgagattataacagtaaaatattcacttagctgctgttatttcaagtcttaaacactgaaattatgcgtgtaccaacactaaattcaagctgtcattaatgaataacaacatgaaattcaaactgtcattattgaataacaacagaggagattaaaactgttcccaacttgcagttattacaaatgtgctaacaaacacaatttgtg

SEQ ID NO: 389672 - DNA, 497 bp, Homo sapiens
gccaacgtccactcccacagccctcaatcaatgctgatagacatggaatcattatcgccaacgtccactcccacagcccctcaatcaatgctggtagacatggaatcattatcaccagtgtccagtcccacagcccctcaatcaatgctgatagacatggaatcacactcaccaatgttcatctcccaaagcccctcaatcaatgttgatagacatggaatcattatcaccaatgtccactcccacagcccctcaatcaatgctgatagacatggaatcatcttcaccaatgttaatctccttttgagtttcctacatcgtttagtcctccaagctagaaacctccatcagaagccatattgcacccctcccttcccacttcaaacaccagatcagttctcagagatgtcctgctaacccagaccgtcctgcacccaccctgctgtctctgccttgctgagctacctcatctgccctggatggtggcatggcctcct

SEQ ID NO: 389673 - DNA, 235 bp, Homo sapiens
ctgaagtaatatggaggaatttaatggttactcttagagatgtaatatttctttatttttcattctagcagccatcagaaaaaaaaatcacaaaaaatctattgcttgtacagtcctgtcatttgtgacctgggatattgtgctcttgggctgtcagaattccagtttatgaggcaatctgtgtcattctggtttagccaggtgagtagtcctctggctctgtagaaaagaacaa

SEQ ID NO: 389674 - DNA, 350 bp, Homo sapiens
agattagacatatgacccagcctggccaattagggattacagttccttggctatagtgattggttcaggattgagggcaagactcaatccattgagaggcagaacttttgtttgtactgtagaaaaatcaaaagctctcttatttctgctagcttggatgaatttaaaggatacatgctgaatggccatgcacagtggctcacatctgtaatcccagcactttgggaggcccaggtggatcacctgaggtcaagagttcgggaccagcctggccaacatggtaaaacttcatctctactaaaaatacaaaaaattagctgggcacggtggcgcatgcctgtagtcacagc

SEQ ID NO: 389675 - DNA, 182 bp, Homo sapiens
ccttggaagccgctgtgtcagagagaagatggagggcaacaggacccagtgggccgctgaggggtacctgcaacttggggagagggagacattgtatagcacctatagttttgcttaaaagccagtagagttgtaccttagaaaccaaccaaaagagaatctaactggagctgaggtggagc

SEQ ID NO: 389676 - DNA, 1264 bp, Homo sapiens
tgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattgaaaatcttaaa

SEQ ID NO: 389677 - DNA, 475 bp, Homo sapiens
tggctccggctccgcacatcccgcttccgagtcctgacctgggacccacctcgtcctgactccaagctgcacacttgtctttctgccaaccccctctcccctcaccgccctcctgcgctcttccgtgtcacctccccagcttccctttctcttccctttttctctcaggggcctttctggtcttcctccacccacgcttaaagcagccaccctcccgctcctcgaatagcagcaccccgcgatttgccacagatcgttgtccacctctcccttcgtctctcctgcctcgcttcccctccgcccgcaccggttctgccagtctctgggttatcaccctcagggtccttgccctggactgcgctctcgatccctggccccttgcagttcccccagctttttctaccctgcttcttcgttttccaaattgtgctctccctcttgcttgcaacccaccagctccaccctcatcaccttt

SEQ ID NO: 389678 - DNA, 343 bp, Homo sapiens
tggctccggctccgcacatcccgcttccgagtcctgacctgggacccacctcgtcctgactccaagctgcacacttgtctttctgccaaccccctctcccctcaccgccctcctgcgctcttccgtgtcacctccccagcttccctttctcttccctttttctctcaggggcctttctggtcttcctccacccacgcttaaagcagccaccctcccgctcctcgaatagcagcaccccgcgatttgccacagatcgttgtccacctctcccttcgtctctcctgcctcgcttcccctccgcccacctctcatgtctctaccgtgccagcaaaagcgacggaca

SEQ ID NO: 389679 - DNA, 335 bp, Homo sapiens
cggtcgctctagacggatcccctcgctggggcctttctggtcttcctccacccacgcttaaagcagccaccctcccgctcctcgaatagcagcaccccgcgatttgccacagatcgttgtccacctctcccttcgtctctcctgcctcgcttcccctccgcccgcaccggttctgccagtctctgggttatcaccctcagggtccttgccctggactgcgctctcgatccctggccccttgcagttcccccagctttttctaccctgcttcttcgttttccaaattgtgctctccctcttgcttgcaacccaccagctccaccctcatcaccttt

SEQ ID NO: 389680 - DNA, 348 bp, Homo sapiens
gtatcctgggaaatggggccccttgagtcttatcaaaagaagtgagaggggccgggcgcggtggctcacgcctgtaatcccagcactttgggaggccgaggcgggtggatcatgaggtccggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggtctgggcgacagagcgagactccgtctcaaaaaaaaaaa

SEQ ID NO: 389681 - DNA, 393 bp, Homo sapiens
gactactactactactaaaaaagcggccgcgtcgacaagaaacggctggacccaactattatgctgaattattgctagctctgagtggtttaaaggattaattatgttattaattacataacgtaaaagtgagtggtgaggttgggcatggtggctcacgcctgtaatcccagcactttggaaggccaaggcaggcggatcacttgaggtcaggaattcatgaccagcctaaccaacgtggcgaaaccctgtctctactaaaaatacattagccaggcatgttggcacgtgcctgtaatcccaggcactcaggaggttgaggcaggagaatcgctctgggagacggaggttgcagtaagctgagatcatgccactgcactccagcctgggtga

SEQ ID NO: 389682 - DNA, 383 bp, Homo sapiens
gttgggagcagcgcccgagtgccctgagagcaggaagaaggctcaggggctcagtgtgctcactggccgggccgagtgggactggaaggaaatcagtgcgagaactcaggcaggaagcggagagccccgctgcatggccctgccaggccaccagtgcactgagtactcagcagatggttcctaggccttgtgtgacctagggtcagacgccttggtgtctctcttggagggctgcacagggtgcggagagaagcttgacagctgcagtatcgggtgatctatgatgtgactaagggcaggccgtaaaattaggtggcatgtagggaaggcttcctataggagggcacaccaggatgggtgtcgtagtttagctggattccatc

SEQ ID NO: 389683 - DNA, 695 bp, Homo sapiens
caagggattcttcccatgctctgccatggctgcctctggtaccctccccctgccttgagatgtcacctctgatgtgtctgggtccccagctggcttacaagctcttgtgacatcagtggcacattttgtggcactgcatttagaaaactgtaaagctggtatatgcactagagatctgtccttcattttcttcattttgtatttaatgctgtcctaactccacaaaatagagacctggaaatgtcaacaattggatatagtataagaattttaaaagtagattttaaaagcacaaaggcaaatttaagttcaatattatggataatgcagtattctgtatttagtagcaatgagatctttcagacctttctttattttgaaatatattatcttctaaggagtgtaagaaagatagcctctgtctaaaccaggggcatgaaaattacatcctctaggaatttgaggaaacattgcagagggcatttgactgcctggagtctgtcggaaagataaggctttatatgcttcagtaatatcctagagcaaaataacagccactgttgagcactgatttatgtaacaccccagtgtaccgggcactattgtatatgataccccagcgaaatagatattattaccatcttcgttcccaggattataaagttgagaacaagaacagtggggtaactcgtcca

SEQ ID NO: 389684 - DNA, 286 bp, Homo sapiens
agatgattgagattgtaccacgtagaagttgtattttgctgttcatgatgacccattgcagcagtaacttaggagggtcagaactgatatttattgttggtgtttataaatcagtggcttctcaaatgactttccttttatagctactatgtagaatctatgtacagagctgagcaatagccaacgcaaagagatggggaggtggcttaagtatgataagttctggtgagtcatactaaggacatttttggccagtgcagtggcttatgcctgtaatcccaatact

SEQ ID NO: 389685 - DNA, 675 bp, Homo sapiens
actaccccccaaccccacccaccaggagcgcctgaccagggaggggctgaggaaggagggggggcagcctcaggatccaggctgccccagggacaatcccgccaagtctaccccgtggatctccttgtccaaacagtccccaatgtagcgactcttcctttaggacctgaggtgggaggatcactcgagcctgggaggttgaggctgcagtgagccaagacggcaccactgcacccttgacctcccaggctcaaggttctcagattctcaggccccaccctggggaaggatggaggatgaggacaagcttcccaggtccacatgacagagggactcaggattggcaatttggcctgtgtccagctttgttgctcagagagctcagatccccaccctcaattcactcccttgtgtggaagggagtgacccttactttctagcacacacagggaagagggcttggctaagagcacccaggaggtcagggcaggactggggattagatcacacccaaatgcaagctctgtggcactcctggtatagccctgctgtccccctgtagcctggccctgggaggggggctcccagacttcacaccccctcacctctttatccaggggaccggctctctcttcctccttcatccccagcctctgccagggcagggtagttcct

SEQ ID NO: 389686 - DNA, 322 bp, Homo sapiens
cacagccagtagtgtgggacgcccttttggtggtgcccaggctgaacttcaagtgacacctggtccctgaaaccccagtagcagggtgagtccctggtcctttcagttctgaacacaacgaggagaaaggctcacctgggtgctgtttggtttccacacctccctagacttgccagtatctctcagacagggagggcaggtcaacagcctgtacctcgttcagtttttgcaagactgttttgagttcattgtatttattgttacaattcccttattacaaggtagcaagtgaatcatgttagctcagggtggggcaatgact

SEQ ID NO: 389687 - DNA, 1082 bp, Homo sapiens
ctttcttttgagttactatatatctttcaagataaacctcttggttaacctttcttttcatctcctgtggtgttctttcaaggttaaatttgagaaaatggagtagcgtagaacatagtatgcagcagttctctactacaagttttaggggccatgctagtcaggatgttgttggttcctttgttttctggtattagtttttagaagcccctcattaatccatactatctttaaggatgttagtaacctcatcgtatagaatttctgcattctaaaggaaacataagcttgtttcagtacactcacgctgtagattaattctgatattacatatctccatcagactttgtaccctctctcttccatcccttacccttaccgattaggttggtattacctaaaaatccatagaaaatgtccaggtgaattgccttatgctttctaccccataaggtataattctagaccagatcggttatgagaggctctattccagtctgcacctgctaagaatttgaatctattttagtaccaatcttggagttcttgtttggctctactcttagccaaccccacagagtctaaaattggatctgaatccagtatttgccagccagtgacagacataaactaggttctttataaatgtttcatgaattgacctgcatccctgcattgattcaggatcttattgtccattgggaaggaagatttacttagctaggagtaacaattcccaaatttgccctagttgcaatatttttttaccaagggtacatacaagtcaggttcacttctgaaagtaaggaaacacaggatagcattcacttgatgatcataacacagtctgggtatacatatgtgtttgtgtgtatacatttaaaaaaaaggtcgtttatatttggttttggaatcaacttttgaatttgtctaaacttgttaagaatttacaagttctatttaaagatatctgggccagaaaccagaaccacttgtgtttaaatactattgctattctgtacacagctcaaggttctggtattttctcttaagcattcctcttctccccttccaccaaaaaa

SEQ ID NO: 389688 - DNA, 883 bp, Homo sapiens
ctttcttttgagttactatatatctttcaagataaacctcttggttaacctttcttttcatctcctgtggtgttctttcaaggttaaatttgagaaaatggagtagcgtagaacatagtatgcagcagttctctactacaagttttaggggccatgctagtcaggatgttgttggttcctttgttttctggtattagtttttagaagcccctcattaatccatactatctttaaggatgttagtaacctcatcgtatagaatttctgcattctaaaggaaacataagcttgtttcagtacactcacgctgtagattaattctgatattacatatctccatcagactttgtaccctctctcttccatcccttacccttaccgattaggttggtattacctaaaaatccatagaaaatgtccaggtgaattgccttatgctttctaccccataaggtataattctagaccagatcggttatgagaggctctattccagtctgcacctgctaagaatttgaatctattttagtaccaatcttggagttcttgtttggctctactcttagccaaccccacagagtctaaaattggatctgaatccagtatttgccagccagtgacagacataaactaggttctttataaatgtttcatgaattgacctgcatccctgcattgattcaggatcttattgtccattgggaaggaagatttacttagctaggagtaacaattcccaaatttgccctagttgcaatatttttttaccaagggtacatacaagtcaggttcacttctgaaagtaaggaaacacaggagtgaacctgacttgtatgtacccttggtaaaaaaatattgcaactagggcaaatttgggaattgt

SEQ ID NO: 389689 - DNA, 310 bp, Homo sapiens
catcatttgggagggcctggaaggacagccttattttaggaatggacctgagttaagaatgaaatagaaggtgaggaagtggagatagcaagtttgaacaagtcattcaagagatttagctacaaacagtaggcagaatataatgcagcaactaaagtagcctgcgttaagagagggtttttgtttctttgtttatgatggacatgacacactcatgtctaataggagggtctgcaatttccagttcagggccttttggctcatgccagcacccttgacaaagtactagcacagttgatatgccaggaac

SEQ ID NO: 389690 - DNA, 3722 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatgatttattctcagctctaaagattgagttgtggtttttagattgttctatgttacgaagaactttgtagtggttatctatatttgtagtttttagggtgtgaaaccttatctactagcaaaattggtaaatcactgtagactcttctatt

SEQ ID NO: 389691 - DNA, 3574 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389692 - DNA, 611 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctgacacaaaaactttggagtcctcaattgttaagcatatgaagaggttcgtgcttgtaatcccagcactttgggaggtgagagcaagaggattgcttaagccaaggacttcaggaccagcgtgggcaacatagggagaccccgtctctac

SEQ ID NO: 389693 - DNA, 3334 bp, Homo sapiens
ggcgtatccttattcacccccgtgacattacacgctggggaccgaactcagtccgagatgtagactaggcaataacgctaatctaatcccgatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389694 - DNA, 2178 bp, Homo sapiens
tctagaggatcccggtcattttcaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389695 - DNA, 3205 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgca

SEQ ID NO: 389696 - DNA, 2011 bp, Homo sapiens
cagcgtacactgatggcagtgaatggtagtgtcgatttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389697 - DNA, 1417 bp, Homo sapiens
aagcagtggtatcaacgcatagtgcccattacggccggggaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389698 - DNA, 2894 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389699 - DNA, 1158 bp, Homo sapiens
ttctagctcggtaccccaccacctgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389700 - DNA, 1004 bp, Homo sapiens
tcagtaagcggagcacgcctgctgggggtatgttgtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389701 - DNA, 3360 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389702 - DNA, 3077 bp, Homo sapiens
gagagagagaactagtctagaggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatga

SEQ ID NO: 389703 - DNA, 3589 bp, Homo sapiens
ctcgtccgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcatagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttccttgtccccctttctcttcctctcccccaaccccgttcttttttccgggttttctttttacaggtttcacaaaaataattaaaagatata

SEQ ID NO: 389704 - DNA, 178 bp, Homo sapiens
tcgcacctgatcggtcgcgaactggccctttccccacccggcagaatctgatttgtaggtcttatactcttcgattgtggcatcaatctaatcttgtttaagttctccctttgccgttgcttcttgggccgtgcttttccgttttgtcttcctcccaccaaatccaaccccagtgttt

SEQ ID NO: 389705 - DNA, 543 bp, Homo sapiens
cctcaagcgatcctcctgcccggacctcccaaactgctgggattataggcatggaccaccgtacttggcctcatttgtcctcttgaaatgaacacttagcattcttctacttccttactaccacaaaatgcatacatgcgtcttcatggtgctgtgtacaaatttctgtggtggtgcgtgtccaggaatggaattgctgtgtcttaaggtatatgggtacctttcattaaagcatacttttcattaaatactgccaaattagtgtctaaaatgatcatatcagtttatacatttatattggccagtatttgaaagtctacttctaatttttgccagtctggcaggtataatcttatctttgttaacatgttcacttctaggattatacaaaatagtaaatgaaaactcgagaataacgccttaggttatccttctcttagaaatgtcactgtttacttgacaagtttggtgtatccgtgtttaagctggagtagttgtctactaagggcaagatctttgtaggacccatgatagagccatact

SEQ ID NO: 389706 - DNA, 944 bp, Homo sapiens
gctcgcagccggacacagactgccttcagctgcgggcggatcgggctggagccgccacggctgctgcggaagaggaaaaacggccaacagcagccccgcggccggcccggcagcgcccggcccccggctcagcccccggagtgcggagccgaccagatactttctgagtgcctactatgtgccatgctgtgctagtgcactgaggacacaggtggacaagcccgaattgctccctgactctcctggcgctcatcacacccggagagtatatgtcatgacccaggccagcagggggctccatgaggattcatagaagatgcaccgcgtactcggacgcctttgtgtgctgcttaccttgcgttggctcgtgatggtctgcctgcagacccgaaatccttgaggatcgctgctatcattggacgagcccatggacgtgcacaccagacggcggacgcggcctctccaatccacctggccaacgaaccgcaatcaacccgatcgactcctgacaaggctggcgcacaccgctcaacgggtcgacgctggaccatctactgacgcctatcatcagaagacacggaggacgtaaccgaggacttgtcacgaatacgcactggtgtacaggactccgtccccacacagcgggggctcggcccgcactgaacgcaccgggaacccaaatcagatcacagtccgcatcacatccaggacgtcccgtgcaatcaagcccacccagcatcctgctgctgaggaaggacagcggacgcggtcccgcaccagcacttgcaccaagactggccccgccctgtacgggacggtccacgtaaaacggactacctcgtgcctccccacgagaaatccgcaaaagccccctagctcgactccagacgccaacgtgcaacacctggaccattccagctgtgtgcatctatagccccgatgag

SEQ ID NO: 389707 - DNA, 529 bp, Homo sapiens
gtctagcttgatctgatggcctagcccctggcccagcccctgcagaggcatcagcgctcgggcccatccagggacggaagcctggccagtgtggtcccccacatgcaggaaggtagtgctgagatgctggctttcctatcacacaggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389708 - DNA, 1904 bp, Homo sapiens
  misc_feature (437)..(437): n is a, c, g, or t
  misc_feature (483)..(483): n is a, c, g, or t
  misc_feature (516)..(516): n is a, c, g, or t
  misc_feature (541)..(541): n is a, c, g, or t
  misc_feature (545)..(545): n is a, c, g, or t
  misc_feature (555)..(555): n is a, c, g, or t
  misc_feature (582)..(582): n is a, c, g, or t
  misc_feature (588)..(589): n is a, c, g, or t
  misc_feature (636)..(636): n is a, c, g, or t
  misc_feature (650)..(652): n is a, c, g, or t
  misc_feature (1009)..(1009): n is a, c, g, or t
  misc_feature (1027)..(1027): n is a, c, g, or t
  misc_feature (1033)..(1033): n is a, c, g, or t
  misc_feature (1071)..(1071): n is a, c, g, or t
  misc_feature (1073)..(1073): n is a, c, g, or t
  misc_feature (1076)..(1076): n is a, c, g, or t
gatcaaggatcccgttggtcgatcactgtacttcacagagagtaattctaagtcttacaggatttcatggagatggcgagagtggtgttggagaatcaatcacatacagagatacaggacagtgagagcaggtagcatttcgaggagcatattcttattcattggcgacggggtctcgctcctgttgtccagcctgggaaacaatgcgagtccctatctctaaaaaattttaaaaaaagaaatctgcatataatagacccacagagtccaaactattgttcagagatcaactgtacttcacagagagtaattctaagtcttacaggatttcatggagatggcgagagtggtgttggagaatcaatcacatacagagatacagtacagtgatcgaccaaggtaacatttgaggagaatattttttttttattgagacngggtcttgctctgttgtccaggctggagtgcagtggcacgaacacngctcactgccgcctcaacctctcctgggttcangtgatcctcctgcctcagcctcccnagtngctgggaccncaggtgtgtgccaccatttctggctantttttnnattttttgtagaggcgggatcccactatttttcccaggctggtctcnaactcctgggctcnnntgatcctcccacctcggcctcccaaagtgctaggattataggcatgagccaccacacccggcctgagtagagtctttaaggtaatgacaaaagtgcctcaaaatataattatttgattaagagaagtcttgggaagataggtaacaacctttaaaatgttcataaaattacatcctttgtaatactcctgcaagtcaaagtaaaggatggcatagactattcttggacagttttgtcaaaaagtgtatcttgaccccaccatcagtactccattcttcattttaaaaaataagatgggctgggcacagtggcttacgcctttaatatcagtactttgggaggctggtgggcggatcncctgagatcaggagttcnagaccngcctggccaacatggtgaaaccccgtctctactaaaantncanaaattagctgggcatggtggtgcgcgcctgtgatcccagccgctcgggaggctgaggcaggagaattgcttgaatccccgaggcggaggttgcactgagccgagatggtgccactgcaccatctggacaacagagcaagactccgtcttggaaaaaaaaaaaaagatgtagaaatgtaaaaatatttgagaattattacatagttgcagatatagtttgctaactccaagaggaaacacattttattttttgtgattgtcctgatgaaactttatccccccacaacatgctgttaagcttggttcccatcataagcatattccccctaagtggacttttactgattttccatggataatgcagacctccagtataaaagctattcctccaggtctctctgccgaccactgagtatcccagggataaggattttaagagtaagagctaagtaataaattcctgcccctagcagggccgttcattttacggatgaaaacctgatccttgctgggcgtggtggctcatgcctataatccaagccattcagaaggctgaggcaggaggattgcttgagcccaggagttcaagaccagcctgtgtaatatagtgagtccccattcagaaaaagaaaagaaacctgagcctagcaaggagaagagaatggtacctttggtggctgttaaatcaccaccgctaccctcagtccacatcagtcctttgaattccaaaggcaggtactctctagctcagaggtcctcgaacttcagcctgtgtgggagtcacccatcctggcacctgattagaaacacagacacccaagtcccattc

SEQ ID NO: 389709 - DNA, 2623 bp, Homo sapiens
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389710 - DNA, 2569 bp, Homo sapiens
  misc_feature (2508)..(2508): n is a, c, g, or t
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgangatttaaaaaaagaggcaaattgtgtttaaaaaccctaatcctcgagggggggcccggtac

SEQ ID NO: 389711 - DNA, 2563 bp, Homo sapiens
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389712 - DNA, 1313 bp, Homo sapiens
tgcttgttcgcaggtgccgtcctccctagaagcagaagaggtgtgaaagaaggtgctgctgggaggggagtctgacaacccagctagctgaagcagcagaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389713 - DNA, 646 bp, Homo sapiens
tcgcagacctctgccgtgaccatgagtacgggatgactgacgcccatgagaaatacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389714 - DNA, 1104 bp, Homo sapiens
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggtggggccctctggccttttgctttgccttcaccactgaccaggcgctgccagaagtcatgtc

SEQ ID NO: 389715 - DNA, 715 bp, Homo sapiens
ctggagtcggagtttgcagtgagcggggattgcgccactgcacttcagcctgggtgagagagcaaaactctgtctcaaataaaaataaaaataaaaaagagccagtattttcctccttgctcctgggaaggagaaggaactggccccgtacaaccagggattcaggacacgtgttactagctccagatgaggatttacacgaaaaaatcctgggccttgtttgtacagttcatgccaggggtaggaaatacctgaagctttcaaatactgcgttagagttgtgactctgtcctgggcaagtcaggcctaaaatggagaaactggtgatgcactcctcaaaaagccaagtgtaaaatgaggttaatgccctccctgacttgttgccttcactggcgtggcatattatggtaaaaataataattaagaagtaaggttatgcaggcaaatcctctagcgccgaaatcttccccgccgcgctaccaggttctttcgtgttatcttggacataacacaacattaattcaactactcggtggagcgcccactagctgctggacactctcttaggccctgggcacagtgaacgagaagcatgtgtctttgtttttacagtctcaccacgccaccacctccctcgggggcctccgcgctgagcttccggcctctacgcctcgcttccggtcggccgccccttccttacttccggttctctatg

SEQ ID NO: 389716 - DNA, 2507 bp, Homo sapiens
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389717 - DNA, 5637 bp, Homo sapiens
  misc_feature (3339)..(3339): n is a, c, g, or t
  misc_feature (3345)..(3345): n is a, c, g, or t
  misc_feature (3372)..(3372): n is a, c, g, or t
  misc_feature (3389)..(3389): n is a, c, g, or t
  misc_feature (3401)..(3401): n is a, c, g, or t
  misc_feature (3710)..(3710): n is a, c, g, or t
  misc_feature (3746)..(3746): n is a, c, g, or t
  misc_feature (4170)..(4170): n is a, c, g, or t
  misc_feature (4216)..(4216): n is a, c, g, or t
  misc_feature (4249)..(4249): n is a, c, g, or t
  misc_feature (4274)..(4274): n is a, c, g, or t
  misc_feature (4278)..(4278): n is a, c, g, or t
  misc_feature (4288)..(4288): n is a, c, g, or t
  misc_feature (4315)..(4315): n is a, c, g, or t
  misc_feature (4321)..(4322): n is a, c, g, or t
  misc_feature (4369)..(4369): n is a, c, g, or t
  misc_feature (4383)..(4385): n is a, c, g, or t
  misc_feature (4742)..(4742): n is a, c, g, or t
  misc_feature (4760)..(4760): n is a, c, g, or t
  misc_feature (4766)..(4766): n is a, c, g, or t
  misc_feature (4804)..(4804): n is a, c, g, or t
  misc_feature (4806)..(4806): n is a, c, g, or t
  misc_feature (4809)..(4809): n is a, c, g, or t
agaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctcacctcttgtctacgcacaccctatttgtgctttgcggggtgaggtcctcatgatcttgtatttattatcccaagttcctgctgttaagaggtggtaggagaagccaaaggcagcagagcacaaaaagcaaaactcttccctccccacccgctcttcccattagtcctgtcagggttgccgatggacaaattgtctctgatcgttggatgttataaatgtctgacagtgcagtgcaaacagaagacaaactcagttgatccttgaacaactcaggggttaggggcaccaacaccccctgccctgcacagttgaaaaatccgtgtataacttttgactccctaaaaacttaactaatagcctgctgttgaccagtagtatgctattagtagttacttactgctaacatagtcagtacatattttcagtatatattttgtatcttatacactgtattcttacaatacagtaaactagagaaaagaaaatgttataaggaaagtcacaagggggcctgagtgcagtggctcacgtctgtaatcccagcactttgggaggccaaggcgggtggatcacttgaggtcaggagtttgagaccagcctggccgacatggtgaaaccctgtctctactaaaaacatggaaattagccaagcgtggtggcgcatgcctgtngtcccngttactcaggaggctgaggcagaattncttgaacccatgaggcngaggttgcagtnagccgagatcacgctcctgcgctccggcttgggcgagagtgagactccgtctcaaaaataaataaataagaaagccataaggaagaaaatatatatctactattaagtagaagtggatcaccataaaggtcttcacatactgtctcagggttgaatagtctaaggaagaggaggggttggtcttggtgtctcagggatggcagaggcagaaaaagtgggggaggtggagggggaggcaggcaccactgttatttttattgaacaaaatctgtgcagggactcatgactgtaatcctagtactttggaangctaaggcgggaggatcccttgaggccaggagttcnggtccagcctgggcaacgtagtgagagaccctgtatctacaaaaaatttaaaaatcagccaggtgtggtggtatgcaccaatggtcccagttactcagaaggctgaggtgggcggatgactggagtccaggagttcaaggtagcagtgagctattcatcgtgcctgtactgtactccagcctgggaaacaatgcgagtccctatctctaaaaaattttaaaaaaagaaatctgcatataatagacccacagagtccaaactattgttcagagatcaactgtacttcacagagagtaattctaagtcttacaggatttcatggagatggcgagagtggtgttggagaatcaatcacatacagagatacagtacagtgatcgaccaaggtaacatttgaggagaatattttttttttattgagacngggtcttgctctgttgtccaggctggagtgcagtggcacgaacacngctcactgccgcctcaacctctcctgggttcangtgatcctcctgcctcagcctcccnagtngctgggaccncaggtgtgtgccaccatttctggctantttttnnattttttgtagaggcgggatcccactatttttcccaggctggtctcnaactcctgggctcnnntgatcctcccacctcggcctcccaaagtgctaggattataggcatgagccaccacacccggcctgagtagagtctttaaggtaatgacaaaagtgcctcaaaatataattatttgattaagagaagtcttgggaagataggtaacaacctttaaaatgttcataaaattacatcctttgtaatactcctgcaagtcaaagtaaaggatggcatagactattcttggacagttttgtcaaaaagtgtatcttgaccccaccatcagtactccattcttcattttaaaaaataagatgggctgggcacagtggcttacgcctttaatatcagtactttgggaggctggtgggcggatcncctgagatcaggagttcnagaccngcctggccaacatggtgaaaccccgtctctactaaaantncanaaattagctgggcatggtggtgcgcgcctgtgatcccagccgctcgggaggctgaggcaggagaattgcttgaatccccgaggcggaggttgcactgagccgagatggtgccactgcaccatctggacaacagagcaagactccgtcttggaaaaaaaaaaaaagatgtagaaatgtaaaaatatttgagaattattacatagttgcagatatagtttgctaactccaagaggaaacacattttattttttgtgattgtcctgatgaaactttatccccccacaacatgctgttaagcttggttcccatcataagcatattccccctaagtggacttttactgattttccatggataatgcagacctccagtataaaagctattcctccaggtctctctgccgaccactgagtatcccagggataaggattttaagagtaagagctaagtaataaattcctgcccctagcagggccgttcattttacggatgaaaacctgatccttgctgggcgtggtggctcatgcctataatccaagccattcagaaggctgaggcaggaggattgcttgagcccaggagttcaagaccagcctgtgtaatatagtgagtccccattcagaaaaagaaaagaaacctgagcctagcaaggagaagagaatggtacctttggtggctgttaaatcaccaccgctaccctcagtccacatcagtcctttgaattccaaaggcaggtactctctagctcagaggtcctcgaacttcagcctgtgtgggagtcacccatcctggcacctgattagaaacacagacacccaagtcccattc

SEQ ID NO: 389718 - DNA, 2505 bp, Homo sapiens
gctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389719 - DNA, 2389 bp, Homo sapiens
gctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389720 - DNA, 1560 bp, Homo sapiens
gctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctga

SEQ ID NO: 389721 - DNA, 384 bp, Homo sapiens
aggccactgcgtatgggcaggcctgtggtgagtatggggcctgggtgaggacaaggggctatgggagcagcagctgtggccgagtgaatcagttggaagcagtacctgctcaggaaatttctcagtcctgcccgaagccctcaggtgacagaagctttcttccctctgcattgcccagcatggctgctctgaccagctggcctaaggctggattaacctgatgggtatttcacaatgggtggctttgagtcattcgtgagcctggctggacagctcttgggtgcagaacccaggcagcctgtctgggctcccaggtgctcaccccatcaaggcacgcttggcagttagatcagtgcctcttgctctgcttcagggtgggggtgc

SEQ ID NO: 389722 - DNA, 140 bp, Homo sapiens
tttcaattttcaaccactttctgtgtgcaggcataaaaagcaaacagcactaacatgaaggatggggaatgcttccattaaccagtaaagactgaatatgctccccccccacaccccacacatatccacaaacctacata

SEQ ID NO: 389723 - DNA, 452 bp, Homo sapiens
aaaatgcttccttcagggccttacaatttaatggaggaaaaccacacaaacctaactattataagtctggtaagtcctatattagtatttgcacctcaaaaacagtatttagggatagagtaaaagccagtggcttctctgtgaccctagctgggtatgcacagagcttctaaatgaccctcaaatttataagtaaaatttaaaatcaggaaaattaccttgtgctttgcttttgttgcttccaatttggatttgtaaattaacaaatggaaattctaagtgacaggcaggtgtgaaagagaactcaaagaaacagctgctttaaggaataatattgaaaacatataaaagctgttaataaataaaaagatgcccatatgtgtattttagaaatccaaaacacttatttcctggcttcttcacaatccctaagtgtaaatagatgttttaaa

SEQ ID NO: 389724 - DNA, 769 bp, Homo sapiens
ctgcagacgaggactatccagccctaggggtacgggagagggaaagacgaggccgagagggaccctgactttgcagcagggtgtctgggcattggtggctccacctgcagaaccaaaagaatccaccaggtctgatgggcaaaggttcctcctcccctgctgcagctaacatggaggacttgcatggagatggtggagtcacaggatgaacacaggctaagtcactacctggaggacagctgcctggacagtcacctggatcgcagtggactgcatgaatgaaaacaaagtgagattgaagagaatgaaaacaaatttgttcccaggttcttggggcttgaaaagatccctttatggagtgaagccactttttctcaacgttctgaaactcacgctgctccagcctgaggcttccagaagtgccctacaggtgcctgagtgtgtgggcctgctgcctgcaagtgcacccggggagtgcggggttggcgtttacagatgtgaccaggggctaagagactggggcgcagcctctccccaacacggactctatttccccacacgctcacttcccctccctcaactgcagtcttctttctctataactaacacagggatcactgcctctattttcttagaggtatagttcatcgctcacccctcacgcagtaagtatgtgttcaggcacagagcaaagggctgagagaagggagctgctgtgggtgcttcaaggaacttacacagaagcagttaacagcagcaggaagatatg

SEQ ID NO: 389725 - DNA, 334 bp, Homo sapiens
cattgtcggtttaaaattgatcattattgagtcttttaggtcaattactacttttccatttgctttctactttctaacttggatgattcagattttccgagaaccaacacttaatacttgcttagggttggttagttggtttgttttttgagacggggcaacatagtgagaccctatctttacaaaaaattaaaaaaattaaccaggtgtggtgtcacatgcctgtagtcccagctacttgggaggctggcttgagcataggaggttgaggctactgtgagtcttgattgtgtcacctcactctagcctgggagacagagcaagaccctgcctc

SEQ ID NO: 389726 - DNA, 562 bp, Homo sapiens
gatgagaaatgaccatttctggagctagagaaagacaaggagggtgaataattacagaaataggttagatgcacgtgaatggaagagagatattcaggaactgtttattgctactgtagatgaaaagaagtaaggacaagtgagtgatttaggcaatcagtaagaagcttgatcttactttctatttatcactctttaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgcc

SEQ ID NO: 389727 - DNA, 453 bp, Homo sapiens
ttgttttaaaataaagtctctctattttacaggactctttttattttaaaactttttttttccagaaacttaggcagtgctggggagtagtatgtccccaggttcagtaagcaaaatgacttcctttgcttattaaacaaacaccagaaattccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgcc

SEQ ID NO: 389728 - DNA, 2534 bp, Homo sapiens
ctccaggctgtggaacctttgttctttcactctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacgctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgcc

SEQ ID NO: 389729 - DNA, 704 bp, Homo sapiens
tttgtgaaggtgcttgtgttttgtttttttaaatataccaataaaaaaaaaaaaaaaaaaaaaaaaaaaaaaaaaaaaaaaaagaatccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgcc

SEQ ID NO: 389730 - DNA, 507 bp, Homo sapiens
ggttgaagatcctgctgactctgcgagcttcttcccagacttagtgtggactctgagagatttctgcttaggcctggaaatagatgggcaacttgtcacaccagatgaatacctggagaattccctaaggccaaagcaaggtaacagggacttcagttttagaaagatttttaaaaaagtaatctaagaaattatctcttttgtttaggtggttaaatttatggttttctatatatatatatattcacccagctctcctaaaaaataaataataaatatttttgtttataatgaacaagtagattcaatattaaattgcattttcctcattcttagaacaaattttcttttttactttccctgattagttaccattttgctttttacttagggtttatgaagatatattaatctaagtgacatcaggtggaaggacatttattcaaggtaaataaatgaaaatgagtgcaaagtctatgctaaataaatcctattttttattctcca

SEQ ID NO: 389731 - DNA, 2815 bp, Homo sapiens
ctccaggctgtggaacctttgttctttcactctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacgctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaaggtgagaagaaagtggaaattatgcaagatagaaagaaatctataaattttaaataaatttggcctggccctcatgggatgttaaactagagcaagaatggcaaagatgcttcttagctcctcaagcatatctgactggcatgatcctgcattgtggttacctggaagggaaaaacaacccctgggaattttatccaggaagttggaacaatcacaaacaaaagtgggaggcagaaggaagaggcacattaatcctagagaagattatctttttctcctcagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgcc

SEQ ID NO: 389732 - DNA, 690 bp, Homo sapiens
atcccagcttatgaagactatctcaagctgttttcccatttagaggttgtggttgtggtggacaatacataatagttctgctttggctaaatttaaaggcctacttggcttaaatcaaaatgagttgttctgacttgatgtttttctgttgggttcttacaagtaatatttttagatgatctctagttaaagagaactaacctcttgagaatgtttgtcaaagttgggcagtttgtgaagttatttaacagaaattttatgaaagttgtgaggagtgggtgatcttattttaattctggggttgattaaaggccacctagaggatcatacagaatttatttggactttccatgatatacaatcccttggcagaacttttctttttaattctaatttaacaatattaggtataattgaatgaaactctcttatttagtttagtatcaagaatatctgaacactattgtgcctttaagtgccttttatgatttttaggccaaactgataattggtcttattttacattttactaatatgtgtttcctgtgaaaattcccaaattttcctgagttctttatatttgaaagtattaacatgttatattgcccaggtaagactagagatgggtgtttgttactattgagaagactatgtcctgaggaagataaaaatttgctttgtcacccagaa

SEQ ID NO: 389733 - DNA, 118 bp, Homo sapiens
attgcaccaccaactggctgataccccatctcttctccctctctttggtcctccctattcactgagacaaaacaacattgaaattaggtcaactggctgggcacggtggctcacgcct

SEQ ID NO: 389734 - DNA, 278 bp, Homo sapiens
ttggggtaatccagcactctgaatatgagggcccaccttggtctcacctaggtggcgtgtgcggctgcagcatgagttagggtcaagggcaaggggaggaatggctggtgatgtgagactggagaaggagctgatggctctgtgcatagctggtcactgcaggcccctgtgggctagggctgagctgtgccccgctgtgttttcagcaccacctcccctacactgggacctcgtctctaactggcagagtggtcaatgaaaaaaagggcatgccttgg

SEQ ID NO: 389735 - DNA, 324 bp, Homo sapiens
aatgtcgctgatggtttagtctggttcaagtgccagtgcctcatgtcactagctgctgtgtgcctttgggtaaactgccccaacctcctgagcttggctgactgtcccctggtgcagtcctcttgggctgtcctatggtctgctactgcaaagcagagcctccttcgagccagtgaagaggcaccataagctctttcttgcctgagcaggctgccctttcttcttcctaacttctcctgcacccctactccctagcaacggccctggacaggttatcagggtatgtcagtatccccatggctttggaggtgctgctccaggaga

SEQ ID NO: 389736 - DNA, 361 bp, Homo sapiens
tctcctgggttcaagtgattctcctgcctcagcctcccgagtagctgggattacaggcatgcgccacgatgcctggctaattttgtatttttagtagagatggggtttctccatgttggtcaggctggtcttgaactcctgacctcaggtgatccacctgcctcggcctcccaaagtgctgagattacaggtgtaagtcaccgcacaccgcccacagagttttaataatttaatcctttcagtgttaaagacacacccttttgactgccctgtaggacagtcaaccattctttgtagattagaagacttgatttttttttttaaagctcagtctctaacatacattctaaaagctttctat

SEQ ID NO: 389737 - DNA, 923 bp, Homo sapiens
aagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgatactggtcttcagattatgagactcgatgataacagtatggtactgcttctgtggacaaatatcgtgccttaacaatgtggtgtccttttccactgaagaaggacagacgttcgatctagaaataaggtggaattttccttgcggtggtttaactgccttcacattggacaggagtggattctgtggatcccagaatttctaaaggagggttgaact

SEQ ID NO: 389738 - DNA, 994 bp, Homo sapiens
gtttggaatcatgtggctgaaaatcttaccatatgctttccacaggctgagcaagaggatagatcattgaatagatgctttaattccatttttgacaatgaaccttgtgcttctgaaaatatttatatttaaccatgaggttatgatgattttttctctacactttttgagaagcctcttcagaaaagagcaaagttgtctgctctaatggatagaataaggagctgggagaaaggagacctgggtattaatctcagctctaccactacatggtagagctatgtagtggtagactatctgggagactctagaatctttaccattccctctactattcctagctcccttttctttcatagtcaacaagtgctttttgaacaattattgaggtaaataacataccctaaaagttagtactgatccccattatcatgctctgttgttccctggatgctcttttgaggaatttacttggttaatacagttaatagtataatacttataataacaattttgagaattatcagcatgagacaatttatttgcataatagctttttgttattatccagaatacatttagttctggattttgtttgatattgtgaatgcaaactatttttttgtgttagcctaaataaaatgaaatacagttatggaaatatttctgctgcaagaaaagaattacatacaactagtatacatatttagaggtgctgtagtcttctagactgtaaaggcagatggccgtgagtggaaatctgagtgtataggatgtgtttcgtgttcccactgcatatgcattattacccttgtctgagtggttgtttaaactgacatctgtaaaactaatctgtaaagtgagatctgggttctgacctatctcttacagtccataatgttgtgattctaagaatatttcattccttactgctttctgccctccattctgaccaatgctgcaaccacaaataaaaacattacttaccctatga

SEQ ID NO: 389739 - DNA, 375 bp, Homo sapiens
gctgaggcagggagaattgcttgaacctgggaggcggaggttgcagtgagccgagatcaggccactgcgctccagcctgggtgacagagcaagactccgtctcaaaaaaataaataaatacaaataaaaaaacaaaaaggaatgttaaataatgataaaaggattagtccaacagaaaaatatcacaatcctaaatatatatcttcctaaaactgtagctctcaaatttattaaacaattactactagacttaagaaactgatgaacaacaacacaataatactgtgggacttcaatcctccactgacagcactagacaggtcatcaagacagaaagtcaacaaaaaaacaatggacttaaactacaccctagaa

SEQ ID NO: 389740 - DNA, 462 bp, Homo sapiens
gccttgtgagttcatctatatccatttccaggaaaggtcatgggctgaggtggtgcttcactgaaataaatgcactttggagttgacagtaaccaagcaaggccagggaccctgaggagacccctccccacacttgcaatgatcaaacatgctacatcttagaaattggatctgccggtttatggcaacttgacgtaaaatgtgtatctcaggtcaggctgatctgatttaaatatcttagtgttaggcattctctatctgacattgtgaaaacgcatataatggaaccaagattagaatatcaagatgacaagaaggattgtaccttgaagacagtaaaagtcacttgcattctggggttacacatttaatttaaaatagttttattccctgttcctagggtccttgtaactctctcctctgctatatttatattaaataaataattttaaatgagtcaaa

SEQ ID NO: 389741 - DNA, 2777 bp, Homo sapiens
gaagaaagccaagaaaagggaccagaagagaaagcacgagaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctcagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389742 - DNA, 2703 bp, Homo sapiens
gaagaaagccaagaaaagggaccagaagagaaagcacgagaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctcagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389743 - DNA, 639 bp, Homo sapiens
cgtacccgttggaatagcgggttttgcagcaattgttgcatatggattatataaactgaagagcaggggaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagaggtgagggcgcccctggctca

SEQ ID NO: 389744 - DNA, 2527 bp, Homo sapiens
tgccgcggctgagccgggcctgagctgccggcaggttgtcttggcaacaggaggtggagaggagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389745 - DNA, 2702 bp, Homo sapiens
gaagaaagccaagaaaagggaccagaagagaaagcacgagaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctcagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389746 - DNA, 2394 bp, Homo sapiens
tgccgcggctgagccgggcctgagctgccggcaggttgtcttggcaacaggaggtggagaggagatgcgccgagggatggaggtgtatgtcaccgaggaggctgctgcgctcctgccccacgccctgggcccttgaagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389747 - DNA, 2527 bp, Homo sapiens
  misc_feature (509)..(509): n is a, c, g, or t
tgccgcggctgagccgggcctgagctgccggcaggttgtcttggcaacaggaggtggagaggagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattcaataatggaaaaagtggagatgaatagaagaagcgagagatagatgtaaaaaaaataaaaatnaaaaaaaaaataaacagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389748 - DNA, 2557 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggatcagactgggtgaataggctgggtttttccctctctcac

SEQ ID NO: 389749 - DNA, 1979 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389750 - DNA, 837 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttccttgaccagcccctcccccaataaactcgcctcttgg

SEQ ID NO: 389751 - DNA, 2573 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389752 - DNA, 434 bp, Homo sapiens
tatgcagtggaagccgtaggagacaggttgtggcatgaacaaacaccctttgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagggggatctggatggacagggggatct

SEQ ID NO: 389753 - DNA, 2510 bp, Homo sapiens
ggttcctggaagagacacctattacctaggctcctgggggaagtgacagcccgtggatctggcctacgcctctcgggcctctgtggcctcagagcgtctgggccacactgtctgggaagagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389754 - DNA, 2623 bp, Homo sapiens
tggcgcgggctcgggtttcctgggctcgcgcggcgcggcccgtgctacctgttggggaagaaaacccgagcccccggaggggccggggccggggccgggacgtgcatccagccgggccccgggccccaggccccaggcccgaggcgcaggcgagggccctgcggagcccggcggagcccgggcggcccgcggacgccaggagcctcctcgggcagcgagattgctttttttccgcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389755 - DNA, 2365 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389756 - DNA, 1827 bp, Homo sapiens
tctagaggaccccccgagttggtcctgatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaaaatctgtctttt

SEQ ID NO: 389757 - DNA, 1922 bp, Homo sapiens
  misc_feature (3)..(3): n is a, c, g, or t
  misc_feature (6)..(6): n is a, c, g, or t
ggnacnaggttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgataaaatcaaagcgatattgacacactacaaacattatagaacctgcaaaaaaa

SEQ ID NO: 389758 - DNA, 162 bp, Homo sapiens
aggatatcaaactcaaacagtttaattgagctacttgtctactgaccaaaaacttcgttttttgggagaggtgctgggctcttgggcaggaaagagggtaaaatgttggctctggtgagtcatctacctgctttcttgctgaccgctgtgtcggtgggtaag

SEQ ID NO: 389759 - DNA, 317 bp, Homo sapiens
tgctgtggagctcacagcaaaccaccacgcagaatttgctgttgattgctcttttcactcctcctctctgaaactagcaagaacaggaagaaatatgtttgttcccagaggtacatacagtactcaactacaggtaccacctctctagactcattttataactcagctgcttaatgccatatttatcagtcttttaaaaaccatatcttctttgataaatatgaaaatctcacgtcttctccacactccgacctcttaagtctataatgtgcctctttagagggtatacagccaatccccatcttctttgaggttct

SEQ ID NO: 389760 - DNA, 115 bp, Homo sapiens
ggttctcacagtcacaaagatgagcaaagctccctggacagccacagactgaaggcactaaatgaccattcgaaggacatctgagaacaaacagaagtaacccttcgtgactcag

SEQ ID NO: 389761 - DNA, 588 bp, Homo sapiens
cctatacgttgatatggtatatttggaaatgaatttggtgatatgtatcaataagctttactgttgataatcttgatctgagaacttcatttttatatttatttgcctaaagaaagactatatttataagggtgtttgtgttgaaatggtcataccagtggaaatggcctacatggaatgggctgtacctcagctggacttcaattcaaatggctgtctgccagctccgagccttggacaagtcacttaacctctaaccctcagtcagtctctatatttttaaatggggacgacaataatccctgtctcagagtgtttttatgaagattacaatgtaatttaatatgcaaagcacttagaaccctgtctagcacggagaaacagcgcagttgtcaccccttctctgcaggggatacattccagggacccccgtggaagcctaaaactccaatagtgtcaactctgtataagcaggttgattatccctaatctgaaaatttgaaatgttctaaaaaccaaaactcagcggtgaaaggaaatccccactggagcatttcggattttcagattgaggcatttaaccagtta

SEQ ID NO: 389762 - DNA, 425 bp, Homo sapiens
ttatcggaagagcagctggagctcacaatttctcccagatgacatcttcttgctgcttaatcttgcttcctagtacccatctgccaggaaactgtgtgcttgcagtctagactaagacccacgactctgcttacccctcctcttgcagtagcaacataaagaccggggatcaattccctggctgaaaaaaaatgagagaaagatccaataggagtctatgtgggtggctctagggggctgctgctttgggttactagaggccaaacctggggaaacttgacccctgtcctgtccctcctgtgtcctgtctgatgctctgcacagaggaaagcagtgtcatgatttgattccagttacagcatttcttgtggcacctcccccatccccaccccaggacgtctttctaccttgcccacctgccagct

SEQ ID NO: 389763 - DNA, 417 bp, Homo sapiens
tattcaaaagaacgaataataagatgtggtcaaggaggagacagaaccagaccacatagagtccttgagagattttattctaaataacatgtaaagccactaaatgtttttggacagaggaataatgatctggttgaggctttagaaacatcatttttctttttgcatagaaagctgaattggtaagatgggggagaagtagaaacaaaaggactagttagaaggctccttagtagtataaccagaccagatgggcctcagattaaggtggtagcaatggaaatgatgagacatggtgagatttagagtagatttgaaggtacagacttgataataggttgcatgtgggctgtaaaagatactgagaaaccaaagaaggctcctggcctttcagcttgaccaactgagtcacgagtg

SEQ ID NO: 389764 - DNA, 373 bp, Homo sapiens
acggagtctttctcaggccatatttagtttgctttaacacgcttaacatttttataatacttcactttttaaattttgcatttgattaaaagttctaatttaatataagttttgcaaagcatcatctctttgaagatctttttttatgctacatgttacccataatagaaaaataaaaaccagaatatctcacctccactggttcgttatactctcctatctcctctcctcctaccatttattatcaattctttctttttctttttcttttctttttttttttttgaaacagtctcactctgtagcccaggctgcagtgcagtggggtgacttcagctcactgcaacctctgcctcatgggttcaagtgattc

SEQ ID NO: 389765 - DNA, 356 bp, Homo sapiens
aagttgtcttggatcacttcttcccttttcgttaactgcagctaccctgaagacatactcttctcctgcagttaagccagatatagttgcttctagagtcttaacttgtgtgcaggtgctccacttttcactccctttagtctgcatttcaaccacataaccagtaattttgctgccaccatcactttctggtttctcccacttaattgtagctgtattacgggtcacatcaacaagagttactcttccaggtgggaggggtggttcagacactttaacgggttctgttgtttcagctggcaaaccaatcccatattcattggaagccaagactcggaagtagtaagaacatcctt

SEQ ID NO: 389766 - DNA, 282 bp, Homo sapiens
gcattacaacaacaacaacaagccaccgaagttaacagagcagtgtcaccaaaacactgtcacaggaaaagagcaaagagactatgcaggaggggaaggcaaacacaggcaacagctcccctaagtacagaggtcctcaaaccatactcctcatcttcaggggccgtgatacactgaccacccatgtgcacttctctaagcagaggacccacagcttagtcccagagccattctaaaagggctctgagattccagaaaggttaagaagcactactctaaagg

SEQ ID NO: 389767 - DNA, 467 bp, Homo sapiens
cacctggctaagttttgttttttcagtagagacggggtttcgccatgttggccaggatggtcttgaactcctcatctcaggtgatccacccgccttggcctctcaaaatgctgggattacaggcataagccaccacgcccggcccccagtacctttcaaaacgtgtaatgagtgtaccctttgacttagcaatttcacttctgcaacttatcctgtagaatgatttgcacaactgtgcaagaaaatatgttcaaagatgttcattattgtttgtaactgtaaaaactggagaaaagagaaatatctaggacaggggtatttaagagatatctctatatgtagtgacgtagaaggatgtctaatttcagaacagtgtagagtgggtctttttctttttgctaaaaatatcatatacaggtgcttatatagacatagacactttcatttagtgtgcatgaaaagagcac

SEQ ID NO: 389768 - DNA, 425 bp, Homo sapiens
gccactgtggccactcagtccaactttgactgcaggtgccttagagaccccaagcaagaaccactaagctgtgctcagctaattcacagaaatatgagagataataaatttaagttttagggtggttagttatatgactatagataacatgcttagataaagtagataaaatagataacatagataaaaatgcttattttattcattaaaaagggtcttttaaattctcttagtcttataagtgaaacactgctttcagttttcttcattttgctcctggaatccttctgactgtattgaaggttgacaggtgacttctcttaggacgagctgaaagacatggctaatttttgtgcatcttcaattaaaaattaaacacttagtagagtgaagttgttgtaattgctgctgtatttaagaaaaac

SEQ ID NO: 389769 - DNA, 818 bp, Homo sapiens
caaactaatattttttcccctctacgtgctgtcactaatcttggattaccactgacccctttctccattactgtatttcccattgttgctgggaaaaaaaaatctgttataaagttacctgtactgagcctctgtcgggggcatgctgctccaacagtttcccttgttagcagtcattctaaacttttccacaaccttccttcttccagggtcattttattcctctgtagagatgattttgctttctgctttcctaagataatctagtgtggcttcattccattattttcttctctcttccctttacaacattactatctcaggatttttttgagctattgtttcttgtctcattcactcacctttttttttcagacactgcatcctctggtttccaaagctagccctttcccttgagcctgtacatcctcctgacctcatcacctctctcctgttatgaacttagcttctttttcttacagacatgcctgcgtttcctcgaccttcaaaacaaaacccggataaaattcttcaaactttttccttttctgttcccctcagaatctagggaaattccatgtatgatcagttttcttctaaggaaatgaggaaggctgatgtgagcaccctagatttttggtcacctttccttccacctatgttttctcatcactgtggcatgactgccttctctactgcttgtaaaactgtattctgaagaaccttagaggatatttagtaagtaacataataaaatagtgccctcatcctaaacctttgttcatgtcttccttcctaaaactgatcatttcacttta

SEQ ID NO: 389770 - DNA, 383 bp, Homo sapiens
tttctaacaattagttgctgatatagaaatagaagtattttccggacatttagtttacatatggccattttgctaaactctattgttaattctgataatgtctcaataattctttgttttttttctgtaggaagtcaaattgtaaatgataacagtttttttttttaattttcaaagcttatagttctttcttcttttttgtttatttgaccacatggcctaagacctacagtacaatgctgagtagtaggattaatagtagataactttattttgtttctgatactaaaggagctgcttctaatattttatttggttgatttttttgcaagtttatggtagacattcttagattagatttgtaaaattcccttctactttta

SEQ ID NO: 389771 - DNA, 695 bp, Homo sapiens
gtgttgtttactacagtccattttatccctaggccttttatttgttttcttttacatcattcccctttcctggttggtttctgtaggtctgggcatcttttataaaaactcataaatctaatattcttccccctcaaagtctattggattgtagatgtttggaccataaaatatgcatgactgggaaagaggggtagacccagtctcagtttctaacttttctgactgtttagaattgataataaagtcttttttaagtccaaagagtttattcatcttattacttttggcttgccagaaagctaaatgctcattactgtgtaagttaagtattgagtgttaacctacagttgctgtatccacaaattactctttttgttcttgaagttaaaaatacagtgtgcaggaagtgaacacttaatccttaatatccttatttttaagtgtccacctcatgaggttgttgtgaagattgaagtagatgatcctcataaaatgctcagcagtgtagcacatagcaagttctcaagttttagccactactaatttatgattcctcattctttctatttgccgcaaaaatgagccttgcaaattgtgatttaatgaattttatatatgaacaaaatgtaccctgttgcctttttcttttgaattttaaattttattatgtgacttacacattactgtttaat

SEQ ID NO: 389772 - DNA, 266 bp, Homo sapiens
ggcctgaggctaccaaactcaacaaggcttgttaagtttttgttttaactaatagttaacagttaagcaaaaccccttaattaaaacaaaagcaatagctaataactaagtagaagtcacaatcagccaaaatcacctccctaaaagaaaatctaaaatgatcttttctaactggaaaggcagtgtgggatactgagcaaggacacaggctctggaggcagatctgggttcaaactccagccccagaacaagatgtgctaagcatg

SEQ ID NO: 389773 - DNA, 2743 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389774 - DNA, 2686 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgagtgagtacatgctggcaaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389775 - DNA, 3848 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagaaaaaaaaaaaaaaaaaaaaaaaaaaaaaaaaaaaaaaaaaaaaggggggcccccccaaaaatttcccccggggggcgccccaaacgctatcacgcgcgccacccccagtcttttctgttgacacaagggtggcgccccccaataagaggaggagctcgcgtattataataacgactagagagcgcgacggcggccgagcacggttataaacaacgcgtgtcgctagatccgtgtgggacaaccaaacgcggttaaccagcgtaggagagccactttggtgagacagcggagcacccccccactatctcttcgcgcgcggggggggagagcaaccaccaactatgtgggccaccgaaacattacccctctctcaagcgcaggatctttctacacacgcgcctcctcaaagggcggggccacatacatatatatcacaccacctcttttccaccggcgctgtctaacaacgctgggtgcgtgttcacaccacccacaatcaccgccgggcacaattattaattgaccctggcggctgccctgccttttagaaaacaaactagtttgtgcgacgtcaaaccaccggcgagactaatcttcgtctgtatctgcacaccagcccttttttttctaccccccccgggcggagccgctcagatagttagataataaccgccggcatcgacaggtctcacatgcagcctacacgctacacaatctctaagaacgcagtccgtaagccactagcggtcgttacactaccaacgccttaatactacgaagtggtgcgagctggactcgactaggatgccgccccggacgcactgatgtggcgtcggcacgggcgagcgagcgagtgcgcgcgctagcaagccggcaggcgagatggtgtatgcggaggagtgatggtggctgctcagcagacgtgtcgttgggactgctctggcgttggtggttgtgtggctgtgtattactggtgctagcggggttgcgtgtaggcttgtgcttgctgctagagcgtgtgcagattgcatgcgccgaaggagacggacgcagaggagcgcgccctgcgaggagtcacacaggaccgaaacgagacaaaaccgcg

SEQ ID NO: 389776 - DNA, 893 bp, Homo sapiens
gtcgtcgggcgcctcccagggccacttgcttagctcagccctctctccctttgtatctgcagccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaaatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389777 - DNA, 2604 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatggcggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389778 - DNA, 496 bp, Homo sapiens
ccacgttacccgtggcaatggccaggggctgacagcatgaatatttttcttcccagggcaattcttccaaccctttgactttaaagtgtctgacatccggccaggctctgaccccacaaagccagatgccacattggtggtgaagaaccatcagctgattgtcaccaggtgaggagacttctcccacaccctcacctgctcagcaacgagaggaggaaagagcacctgcagcccaggcacattagtctggtgggcttttgtcttctgtggggtacccttgtttccctttgaggtcttggcccctcccaggctcttgctaatcaagaaaaagcccaaacttggcttcctcgaaagagtaatcatgtaacttcattcttgaccaaagaattctgggctgttagaattgccaacttcccaccctttttcaatctcaggtccgctagcctagcagccatcttacccaccccgtgtattgcagcatctctcttctttcccc

SEQ ID NO: 389779 - DNA, 281 bp, Homo sapiens
cagcgttcatgcccaacctgtacagattccctcctcaatggagatttcactatcacctatgacgtgaacagagaatctcctggcaacgtgcaggtacccgggctggctgattcatcatcagggtggggcgagggctggtcgggcgggggctgcagctggatctagtgccatcaccctgggtcctcagcccaaggctgttttcctgcaggatgtgggacagctgatggcctagagcctggtgcagcaccccctagagggtgggataggaacgtctttttctt

SEQ ID NO: 389780 - DNA, 2805 bp, Homo sapiens
gagtattcagcgatggacatttgcatggtggccctgtctcatcttggctctgctctccagcttggcagcctctggcttcccgagaagcccctttcggctgcttggggagaaacggagcctcccggaagggcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaatgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389781 - DNA, 2690 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaaatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccaga

SEQ ID NO: 389782 - DNA, 2801 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagaaaaaaaaaacgcaccagctcccttctgcctggatgttccacctttggcgctctggtct

SEQ ID NO: 389783 - DNA, 2733 bp, Homo sapiens
  misc_feature (2651)..(2654): n is a, c, g, or t
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgcaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttggaannnngtgtagaaataaacatgaaagaggtccaatcaatgttttaatctgctaacatttatccctttttagcttaaaaaaaaaa

SEQ ID NO: 389784 - DNA, 2021 bp, Homo sapiens
gagtattcagcgatggacatttgcatggtggccctgtctcatcttggctctgctctccagcttggcagcctctggcttcccgagaagcccctttcggctgcttggggagcaagggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtattgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagggatggaggccggaacccggaggcctcctgtgctgggcaccctacctgggtgtccagtggaggagtgggccaggctggggagacccagacctgctgaagtagggcatctgaaggaaaatggggtgtggggtgaataggagcctctgcacctctaaagggaagtgagtaaagggggcacactgcccatggggcatt

SEQ ID NO: 389785 - DNA, 335 bp, Homo sapiens
tcccacttcttacacatatttaaactgtagttgtagcttgaatccaaacaataaaaactgaacagctagttcaaaccccaggaggctcagttctacacttgggtcaccaggtagtttttttagataattttaggaaaatacactgcttttaaggttcatgacacatttatgaaatctttggacagttgtttgttttatatgatttatcagttttccccttaaaagataaggtcaactgtagttatgaataagttaatacattttgaaaatctggaactcttaagattggtcattcagtcagtttaggtcctaaacaggaattttattcattgttt

SEQ ID NO: 389786 - DNA, 261 bp, Homo sapiens
  misc_feature (224)..(224): n is a, c, g, or t
agctgtgccttctcctgcccagtctaagccaggagcctgcgaaaaacaacccaagggcctcccattcttcatgcagcagctcaaaggcaactaagaagcagctggaacattcatgaagccttaatatgattttaatttaggatattaagacagctgcagtgacctcacactcctagcttttaaactcaagtctaatgactcttttgctgctcctgcctatcagntaccccacctctgtgcacgtctggtgcaggcatacct

SEQ ID NO: 389787 - DNA, 809 bp, Homo sapiens
aagtctttgaaattcagtctgtttattatacttgctgcacgtctcaatttggatatggaaacgtcatcagaaaggcttgatctgtatttagagtccataaaattcacagttgaacaaagaagtagattcacacacccaagctgctccagacgcataaaaatcttcgttactgaaccgagtatggttcctgactgggaatctctcatagttacgatttttttaatttggaaataattttagacacagaagagctgcaaagatagtacagagaattcccataggacctcccccacaacccaacctcccttaatgttaacatctcacataaccatggtccagtgatcaaaaccaagacagtagcatcagtacaatcgccgtgaactaaactagggacttgccttgggtttcccagttttcaattcatgttctttttctgttgtggaacccaccccaggatgctgcactgttgcctgtgtctctttcctcagtctttcatgaccttgatatctttgaaatgtgctagtggggtattatgtagactctccctctacttgccgttttctcatggctagtccgtggctatagagttccataagaagaccacagaggtaaatgcacttcctcttccatcatattaggaagtgccagatattaacatgatccatggttaacagccgaggttgaccttgatctcctggttaagtggcatctgccaggtttctccactggttgttgcttagaagaagcaggtcactaagtccagcccacactcaagggagaggaattaacccctccatcctggtgggcgt

SEQ ID NO: 389788 - DNA, 328 bp, Homo sapiens
ccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttg

SEQ ID NO: 389789 - DNA, 805 bp, Homo sapiens
agtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatctgtagcacgatatactgaaacgcgaacaactctatccacgaaagcaaaggaaccagagagaatcccttatctaccgaagactacccacgatgtaaagtctaatctactcttcagtgaactttccaaagaccaaaggtgactgcacgaacgactggggcaacgaatactgatgacccttttgcttgggcctccagacactatttcattagcctcagacacgatactgactcacagactgatgaagcccccctctgatgcacgcccaagtttcctccaattgcagcacaagaccttccttttgttctaacaggctggctacctctgcacacacgcatcaccagactcccagctttctggcgatctgatcactccgcacaacaccgcatgcgcgtgacctcctcagcctacctcccgcctactccttacctcccttcattgcccacctgaccaccccgaccaccccacacaccacaagcgttgaacttcgccctcaccatctccctaccccgctgccccctattgccatacccctccccacacacccgcccgaccaccccatcc

SEQ ID NO: 389790 - DNA, 484 bp, Homo sapiens
agtctttccttccaaggagataactaagtttgagtcattgtttaaaaaatcaacttccactagtccagctatgacccctgaaatgccttccatttcaccttctactttctgtctaaagaagagggtttactgagctaattgcaggtctgaatcgtattatcgggaaaaggtttatcttacttgggagaacacagctattttaaggagctttagcacatttttattgcatccacctggcatgagaaatctccattgtgagcctccttggggtacccattcccattagaaaacagttcatcagcccagaagaggggaaaggagagagagaaggaagggcaaacgctggacacgcaggggtccccccgccccaattatccatcatttgtggggttccacatgcacctagtgcacagtgagtgtgaactcacggagacagactcaagtcatgtgcacgcatcccttttcaatgtgggtgctgggcaga

SEQ ID NO: 389791 - DNA, 395 bp, Homo sapiens
agttgtgctaccatctctacaatccagttgtagaacatttctaccaccccaaaaagatcccttatacccatttacggtcactcccctttccagcccctagtcccagtcaaccattcatctgttttctgtctatagatttgtcttttctggacagttcataaaaatggaataatatgtggtcatttgtttcttctctcacttagcatgtttttggggttcatccacattgcagcatgtatcagaactttattcctttgatggcccagtaatatacaccagttgatgaaccttttgagttgtttttactttttggctattcacagttgtcatttttaacagctgcagaatgtgaggagaacttttctaaataaccacataggaaatagtaaagtgac

SEQ ID NO: 389792 - DNA, 271 bp, Homo sapiens
catggtatttctctgtgatgctcttcgtgtgtgtgtgtgtgtgtgtgtgtatgtgtgtgtgtgtgtgtgtgtttttaaacacctctttaaattataagctccctgcaggcagattgctgtgttttatctcctcagcagtgtggggcatgtcctgagcactggttaaaggtagtcttcaggttactgagatgtgcattaataggcttcactattaagcaaatataaagccaatttcaggtaattaatctctgaaatttttgtttcagattaa

SEQ ID NO: 389793 - DNA, 201 bp, Homo sapiens
gattgggaagagttatttagcccatctctccattacctgcagttgctctgcattttaccctctgagtgaatcctcagccttcactgaaattctacaaagttaggggatgcgatatctactaggagcccactctgcctttggagtaatctgactgacagagggttttttggcctataataaatgtagcttctatttatcctt

SEQ ID NO: 389794 - DNA, 581 bp, Homo sapiens
ggcacatcagttcagaatactgccaaaaataagttttacaaagcttctgcaagttagaaagaaagagagagggagaagaagccacgtggaaagcagcaggattcagaatggctttgtacttctcaacactagccctggaatccagaagaccatggagcaatgccttccaaattgtgaagaaaaattacttccaaccttgagttcaatactcagccataaattggaggggaggtagaactaaaacacttttagaaatgtaaggtctcaaaagatgtgcttttcgtgcacactttctcaggaagctattgaagatgccctgtattagtctgttttcatgctgctgataaaagacatacctgagactgagaagaaaaagagatttaattggacttctagttccacatggctggggaggcctctgaatcatggcaggaggtgaaaggcacttcttacatggcagccacaagagaaaaatgaggaagaacaaaaagcggaaaccctgataaacccatcagatctcatgagatttattcactatcacaggaatagaacaggcccctttgattcaattacttcccccg

SEQ ID NO: 389795 - DNA, 485 bp, Homo sapiens
tttaactaacaaatctgaaacgtgaccaaaatagtttgtatggtaatccatcttcatagggggtcagattagggcttattttttgaataaagtttttggaatattcgtcttttttagaaagtggtcagaaaaccccggggttgatttttgactggaggtgttcctggagtaaaagttttaaattagatcagctcccagtactcagtcagccatcattttggtcagatactataaagcagtgattcccaaacttgaatattcagcagagtcactgcaggcttgtcaagacagatttctgcctccaacttaccaagtttctgattcagcagattttggttgggacctgagaatttacatttctaaccagctcaccggtgaccgtaattgtggtggtcagggaccacactctgagaatctgtgctctaaaggaatggattagcagaatatagtcagtaaagaattaatagaaccaagttggctaagaa

SEQ ID NO: 389796 - DNA, 276 bp, Homo sapiens
taaaaaactacttaggaagatgtttcaaaattaaataaggaaagagaaatgcaattatgattagctgaagttcaagttgtgatttactgtttttaacatgtttgctccgtccatctgtttgattccagaacgccttggaatgtcttttctggttatttcacattcgttgaatgagactgccaatgtcagctttagcttactgttgagagtaaaaatattaagacagtcttctcaattgccgtttggaacaccaacgctatccctggaagtcacctg

SEQ ID NO: 389797 - DNA, 268 bp, Homo sapiens
tggcagtttcacagtgatatatctaggaggggatttttgtccttatcttttagaattttttctgattttttgaaattcttggggctttgatttggtgttcattgctaataaaaaaaaaaaacttgaccattatctcaataaatacgttttttacctcaccttttgtcttctatggcattccatttgtatgcttatttaacagtttgatattatcccgcaccttttaaatgctttgttctgatttatttttcactcttttctcttcctt

SEQ ID NO: 389798 - DNA, 434 bp, Homo sapiens
aagcaagtcagctctagctgaaggtagaaaacgtacatgatccaagggcactggtatttataaatgtataatgataaggcagaatcattccaaaagagaagtgaatacaagattgagtcaaagtattccaaactcaaaagaagctcaattcctttttttggagaattgtccactccaccctagtttccagataaattaatcaccaaaggggtattatcaagtgggttcttcttttcaccatatgccagcaagatttggtgtggatttgatgtggtagataaggaaggaattgtatcctatacggttgttttcatatgcataagattgtgtatggaaattttcccacttctgtaaggttttcaaaccataagtggttaaccagaggctaacaaaatggttaaccaaatgtgtcaaccactaagccaagtggaaat

SEQ ID NO: 389799 - DNA, 435 bp, Homo sapiens
ggccttagctttttaaattttaaatgaatttcccaactatgtagacatgaagtcctttctggtttagtgtcaaaataaaagatactaatgagaatgtctttgggacataattatgtagatttaaaggagtgatgtagttttaattatgccctttagctagtgtacttacatattaagctcattcatgtctccttttccctctgaaacattgcttttctcaagccctaaattagtaatcagctcatgggtgtacctgaaggttatgtaagttaagttgaaggctgccaaagaatgtgtttaaactactaatccaaaacatactgtttatagttagaaaaaaatggcccatgggtttacagtgttcttcgctggattgacatggaggaaattccagccttgtatgtttatgtgttcctttctctttccctccccaaa

SEQ ID NO: 389800 - DNA, 391 bp, Homo sapiens
ggctccctcctcctcggggaagccaagagcaggtggggccgggccactttccggtgccctggccactctggatgtgctcagtgctctcagaggcccgagaggcaggcaggattgttaccccattttcggggatcagataacaagccccacctcggcaggtgactgagccagaattcgaactcaggcactttcatccatgcaacatacatagatgatacggctgctgtgcaccacgccgtggggtgggcctgggctgcaaaggacacagtctctaattccggataaggggtaacacatgtgaatggaaaaggaaccatggtgcatgagaggcaggagtctggcctacaggggagggaagcagtggggaaggctgcctggaggagagggtgct

SEQ ID NO: 389801 - DNA, 298 bp, Homo sapiens
tctgcctggtgtttctctgacaaacagcggagaaccctcagttctgaatgaagatctgggtttcctttgagtacgggggattggtttccactctggctactgcagacacaaaagccgaggggagaaaaaagaccccctggttcactcctaaggctggggctccagagaacagctcaggctgggagcacaggagggagggaaccagaggaggaagcgctcggctgtgccggccccgccaggcccggctcatgggccaggacatgcaaaacgcagggaggtggtgggggcattctgggtg

SEQ ID NO: 389802 - DNA, 792 bp, Homo sapiens
aaaaaaaagaagttagctaccatccaatccagaatgaggtcttgatacacccttggacctaggtgggtagctcaggggagcagatacatttttttcttgtgttaataattcttcagctgagcttcctcattatggcaggcagtgatcttgaccagctccttcctttactcaaaaagcccagtgtccccacatatacttttacgctactccggaattccaagtcagtctgaaattttaacttccccctccccatcacacacacacacacacacacacacacaaacctcttaaagaagaaatatttctgaaaaagagaagttgatttcctgttaccttaaatagacatcatttccccacattttcacactgggtggaagctctagatataaacaaattattcacttgtttaaagtttcttttaaatttattcagcttttgcctgttcgtattatcttattataatatccactggaccattctcaaactgcaactgctaggttacagttcatcctactttcccaggaaatttcttatcataagaaagaataagtcccaagaaaagaaaatcaagcagtgagaaaataaaaattatatgcacatgtacatatctggggatgaacaggaatgtttgaaaagacttcagaagaagcattccacatgaaaggtataatgaagcagttcactgttctttgtccagacttgattattagaatttcagtaacgatttttttttccaggggtaagtctgttgtgctgctctttgttgttttaacagattgccttgtaaatgaa

SEQ ID NO: 389803 - DNA, 398 bp, Homo sapiens
ctcccaggttcacgccattctcctgcctcagcctcccgagtagttgggactacaggcgcctgccgccacgcccagctaatattttttatttttagtagatgggtttgcaccgtgttagctaggatggtcttgatctcctgacctcgtgatccacctgaattttttttttttttggttcacgttctctcatgatcttcccgaaatgttatccttaagcttcggggagaggtgagcaacggaaggaactggcccaggctggtctcaaacttgtagcctcaaactgtcctgctgcctctgtcttccaaagtgctgggattataggtgttgagccaccatgcccagcccttctctgatctttaaggtgagaagctaacgtttttagccacttcagtgaaaaa

SEQ ID NO: 389804 - DNA, 195 bp, Homo sapiens
tgaaaattcgaggtctaacctcccccccgccctgccccttgagggcagcaatgctttcagaagctcacagggcaactccaatatgcggggcttgtgagaagcctattttaggctaagggtcgtcagcagcaaatagccaacatcctctccagcaggatacactgaggaaggacaggtggtttagacagagagcgc

SEQ ID NO: 389805 - DNA, 650 bp, Homo sapiens
cccatgttactgtccgtgtcttcattgaaatataggaggtcgtctactaagagtagtggctttcaaccttgactgcagatcggaatcatctaggatttttaaaactaccagtgcccaggccctacccccgatacagttagtctggagaggagcctaggtatcaatacaccgtaaagcttctaggaggtccacaagtcatcagggcttaacatggtccacacaagagaagtaccagctgccatgggagcactgcggaggtgcccggacttcacgcgagggtgttctagcagagggggcagcaaaggcaaaagcctggaggtgaaggatgtcttaagggaacaaagaaagttggtgtggctggagcatgtgggtggtcaaggaccacataattgctgcagtttatcctagggtcagaggaaagccatccaggggttttaagaagggaagggtgacatgagttatgttttaggagaatcattcagttgcttggagaatagattggaggaggaggaaagtagaagcagagaggccactgggaggctgctaacagaacgccaggctcaaaagatgcccggactggaggatacccaggagaggagtgaagatcttcaagatcagtggcagaattgataggacctggtagtagattg

SEQ ID NO: 389806 - DNA, 378 bp, Homo sapiens
cgcctcccgggttcacgccattctcctgcttcagcctccccagtagctgggactaaggcacccgccaccacgcccggctaattttttgtattttttagtagagacgggtttcaccatgttagccaggatggtctcgagctcctgacctcatgatctgcccgcctcggcctcccaaagtgccgggattacaggcgtgagccactgcacccggactgtgctttctttttcaatcgaggttagagttggccatgagggaacttatataagatttggaaggcagaagcaaaagagcagccattactctcagaaggtcactgtggttggatatggtgttggccaataggtcaaacctccatgtccatctgctctttcttatgt

SEQ ID NO: 389807 - DNA, 422 bp, Homo sapiens
aggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaaattagccgggcatggtggcacatgccattagtgtcagttatttagaaggccgagacggggggatcatttgatcccgggaagtgaaggtgctgt

SEQ ID NO: 389808 - DNA, 108 bp, Homo sapiens
tggtgggtgtaaatacgtaactgtttccccacattataacaaatgccttgtaaacagcagttcagacactgcaaacatatcccatcctgtagctgtcctatggattct

SEQ ID NO: 389809 - DNA, 726 bp, Homo sapiens
tgttcttttttctagaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgaagacagtctttctcatcttgttcctgccttgaggttaccaggtagaaaacttggtgtcctccaggttgtttcttcccaagatcataactcaagagggctctttcccaggaggttcctgaaggcgaagcccttggacacagtgctc

SEQ ID NO: 389810 - DNA, 681 bp, Homo sapiens
  misc_feature (648)..(648): n is a, c, g, or t
tgttcttttttctagaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgaagacaggttatggaaggggacctacaaaatgggaatttcatgtacagtggtgtgggaggaataaagcaggtgggtggttataccttcacatgagggntgcaggccaaaggtttggcaacttatagtaaca

SEQ ID NO: 389811 - DNA, 148 bp, Homo sapiens
ctgaatccattagccttactttgtcagtcatattaaagcaaaaagaacctatggcaagctttctgatacgccaagcaatgaatgatagtatttgaagctccaggactgctgagatcacgaaaggctaaggaccagagaggcagccaag

SEQ ID NO: 389812 - DNA, 351 bp, Homo sapiens
accaacaagatgagggtaacctgctgagccttcctatctgcagcaaaaagtaggccttggagttcagaagtagagcaactgttattttcactgagaaggaaagttccttctcaagtcagctgctgatctttctatggaatgagaaggagtgggaaccatgaaagaagagcttgggaggtcaatgggaccgagatagagggtgaagttcagggggaagaactcaaagggggaaccacagcatccctctccccatccccaaggtggcacgtgaatgttctggagatgaacaaagggcaggagggagtaggggcatgggagagctccagggcagccgccgtgcagaggagcaga

SEQ ID NO: 389813 - DNA, 1014 bp, Homo sapiens
ctgaactgaggctacactggccacagggagtcttggggaaatgagaaaaaggatgagaacgagatgaagtctggagaagtgcccacccctgtaacacacacacacaccacgcgagctgaatagtgtcaattccattatatgttgaatccacagtatctctgaatgtaactgtatttggagatagggtctttaaaaaggtaattaaaatgaagtctttatgctgggccctaaaaaaaacaacaaaaaaaaaaaaaaaaaacaaaaaacaaaaccacaacaaaaaacaccaaaaaaaaaaaaaagcggggacccccgcgacacatgaccaccacaggagaaacaagaacaagaaaaaacggaagcgcaaaacaagaaagaggacgacaaactagccccccagaaaaaaacaaaaaatacggcagcaaaacaccacgacggaaaaacaagaaacaaacagaccggcagaaaatcccagagaaaacgaaaaatacaaagagagatcagaccaaagagagaaaagaagacgcaacaaaaaaaagaaataaaaagaaaaaaaaaacagaaaaaacgagacggaggaggcaaacaaagaagaacaagagaccacagagacccacggcgcgcggcgaccgaccggcaccacccgccacccagaagacaacaagaaccaagaagagaaaacaaaaaaaggacagcagcggagggaacgcggaggataaggaaaggcaatgtagatactacagaagaggaaagaggaggaaggagccaacgctccgactgcaccgacaataagcgcacaccagagagagcagagaccggagcgagagaggaagacagcacggaggaggagaacagagcagcagaggaaaagagcggagacagagagagaagagaaacagcggacaaaaagacaagaacagaacagcacaaaaaaaaacccggaaaggagccgacgaagaggaacgacaagagaaggagagagcaagacacagcacagaaggacgaagaaagaag

SEQ ID NO: 389814 - DNA, 333 bp, Homo sapiens
tatatttgatgctaatgatctggtctgtgggtcatgtgggtgtctcctgtctcctgatccacctaacactgatgacaaagctcattagtacctctggccagagggtggacttgaggaaagagaggacagcactcatgtcaatcagtttggcttctcattagtaactccaaagaaaatagttggccaaagaggccagaaccacaaaaaggaagctaactttgagtcacccatatctgtccactattatcacagaggtgggaaaaggctaagtgtctggtatgtggtaagtggatgaagtgaaatgatattttttaaggctaaaataaaacttgt

SEQ ID NO: 389815 - DNA, 305 bp, Homo sapiens
  misc_feature (242)..(242): n is a, c, g, or t
  misc_feature (247)..(247): n is a, c, g, or t
  misc_feature (258)..(258): n is a, c, g, or t
aataaaaatgcctggggacagaagctgcttaggatgcgcccctgtgctcatgaaactatgactgattctgggactaagggatgtgacgggaaagggacaggaagaaaaaaggaaatgggaaatcaagagcaaaaaacagcaaaggacaataaatcaattcaagaagatattaccatcactcccagggagtgcaaggtttctaaggagcaagctggctctcctcactcattgctgcctggggnttctnatactaggtgntattgaaacttctaaaagtaggtgctattgaaacttctaaaactagg

SEQ ID NO: 389816 - DNA, 724 bp, Homo sapiens
tacacatgtggctgcaactgagacactggagcagcccagcaagcccagaggaattccgaattccaagaacctggacaacttgccgtcaagactttccatcaggtcttaaaaataaatatgaatttagattccatacatcgattaattgaggaaacacagatcttccagatgcaacaatcatcaattaagtcacgcggcgacatggtggcccctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaatgttacccaggatctgaagcttcctggcttcgtagaagaatcctgtgaacatacagaccaatttcaattgagttcacaaatgcatgagtctatcagagagtattcggtacaaagacaattttctacaaaggaggacacaaataataagg

SEQ ID NO: 389817 - DNA, 673 bp, Homo sapiens
tacacatgtggctgcaactgagacactggagcagcccagcaagcccagagggtcttaaaaataaatatgaatttagattccatacatcgattaattgaggaaacacagatcttccagatgcaacaatcatcaattaagtcacgcggcgacatggtggcccctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaatgttacccaggatctgaagcttcctggcttcgtagaagaatcctgtgaacatacagaccaatttcaattgagttcacaaatgcatgagtctatcagagagtattcggtacaaagacaattttctacaaaggaggacacaaataataagg

SEQ ID NO: 389818 - DNA, 119 bp, Homo sapiens
tccctcccttcagacacccaccactgtcttggacagatggggtaatcacaaatccttactaaatctttttgtcttattctccaacctcagccccttttaaaaactcacagcacatctca

SEQ ID NO: 389819 - DNA, 462 bp, Homo sapiens
tttactcttgtcaccgaggctggagtgcaatggcgcagtcttggctcactgcaacctccgcctcccaggttcaagcgattctcttagcctcccgagtagctgggattacaggcgcctaccaccacacccagctaatttttgtattttttttagtagagatggggtttcaccatgttggccaggctggtcttgaactcctgacctcaggtgatctgcccaccttggactcccagagtgctgggattacaggcatgagccaccgcgccccaccagatttcctttttaaacaatgaatttttattttttatttttttggagacagggtctctctatgttgctcatgctggtctcaaattcctaaactcctgggatggagcagtcctcctacctcagcctcccaaagtgttgagattacaggtatgaggtatgagccactgagcctgacatgaatttaaaaaagca

SEQ ID NO: 389820 - DNA, 2949 bp, Homo sapiens
tgctggcttgctgaatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatga

SEQ ID NO: 389821 - DNA, 1281 bp, Homo sapiens
gtgtatcttcccggatctttctctgtgcgtgtgtgtggtgcgtgtgtgtgtgtgcgtgtatggatgtatacgtgtgtgtgtgttgttattgtcgtttttaaacaaaagtgggaacgtagtgtgccatgtctcggtgaccaaaataatccacggtagttgctttgccaaacaaagtgttttcaactcatctgattctaaaaggtttttggcaatatgttaagaaactaagagcacagaccagtacttttttgaaaattctctacttaaaagttcacttttttatttcctctagtgtggattttcttttctagaatgtttttaggcccacaaaagaggcttttattctgtctgatttgatgaactgagataaattaacatactggcttcttagaatgctaagtgtttgaccccaaaatcctcacattttacaacaagtaaatcctttgctctagaggaaaaaatatcctacaagtcttcagggaactgtcttctggtttagtagaggatgaagattttctttcttttttttccccccccatattcagcttgaattgcagtaacataattcattctcatggcctttgcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatga

SEQ ID NO: 389822 - DNA, 509 bp, Homo sapiens
tcctgtgcatctttatctcctaccatcatcattccaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcaggtaacccatcagccgccggcagctccagcgagcctgaaaccaaattctgagagccgggcagttacttggtggctcgcgtgatcccagagatgctgtcgcagtggctagggaattgcttcctgtgttaagactaggagtcggggctcccaaa

SEQ ID NO: 389823 - DNA, 2135 bp, Homo sapiens
tgctggcttgctgaatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattatttcaataaaggatcatttgacaactggtgaaa

SEQ ID NO: 389824 - DNA, 517 bp, Homo sapiens
gtccaaactaatcttgaactcctgagcgcaagtgatctgcctgccttggtctcccaaagtgctgggattacaggcgtgatccactgcgcccaaccgatgaaaatattttagtcactaatctattcctttttcacggaactgaatctagtgtgctaaattaaagaactatttgaactttcagtggcatattaaattcagtagccacattgtgttttatttaaactcagcttatcttgtcatatcattcttgtctcccaattttatcacaaaaaataaaataatgaactaatatattttcttctgtctttctctgcctcaaacccttccctaatctgaatgatggtagaaaaaaaggccaggatgaagacagtgaggagttgtggtggcgaatcatgtgctctgctttaaatctttttttaaaagttgttattttattttcagactcccagggaagcagatgagagtgcatggtttgtcagcccatgtctcccccacagttgtatctgtacagcctaat

SEQ ID NO: 389825 - DNA, 600 bp, Homo sapiens
gcttggatcttggcactgagaggcggtggccggcgggatggagaaaagtaggatgaacctgcccaaggggccggacacgctctgcttcgacaaggacgagttcatgaaggtgcgcgcggcgtccgctccccggagccgggccatgagggtgcctctgccctgtgccctctgtggcggtctcttcggtcggctgctcctgcctgcgcacgctcagtgtcaggtcctccgccgagacctcgctgcacttcgcaatgagtcttttggcgtcaggtttggcgggtgcagcctggagaaagcacttctgtaaaatcgtgcgtgttacatggaaaggcctgaaagttctgggcaagtggttttgagctgcatgtcaaagccactgttacccgttcctgttaccatgcagtgcagtcagattgccagtccccttgtcggaaagaagcttgtggaccggggccttggagctcattaagtgtgtgttgaataaatctccaagcccacgtactttcctagggactcgggtcggaaagaaaaagaacttaatctgaagttttgcttaacattcagctaaagcttccagaatgggatatttagaagcttaga

SEQ ID NO: 389826 - DNA, 267 bp, Homo sapiens
ctttgtaagtagattatggtatattttactgatatgtgcccttattttacagtgaaaaaggcaatactgttcctggatatgactttttggtgaattctgtttggccacaaatagtacaaggattagaagaaaagttaccctcgctttttaatcctgggaatcccgatgcatttcatgaggtatctccccgcccgtcgtcttgattcttgaagatgttaaccggagactggagaaatatcatgttctcttctacttagtcttggttct

SEQ ID NO: 389827 - DNA, 2315 bp, Homo sapiens
  misc_feature (1295)..(1295): n is a, c, g, or t
  misc_feature (1299)..(1299): n is a, c, g, or t
  misc_feature (1304)..(1304): n is a, c, g, or t
  misc_feature (2192)..(2192): n is a, c, g, or t
gtgtatcttcccggatctttctctgtgcgtgtgtgtggtgcgtgtgtgtgtgtgcgtgtatggatgtatacgtgtgtgtgtgttgttattgtcgtttttaaacaaaagtgggaacgtagtgtgccatgtctcggtgaccaaaataatccacggtagttgctttgccaaacaaagtgttttcaactcatctgattctaaaaggtttttggcaatatgttaagaaactaagagcacagaccagtacttttttgaaaattctctacttaaaagttcacttttttatttcctctagtgtggattttcttttctagaatgtttttaggcccacaaaagaggcttttattctgtctgatttgatgaactgagataaattaacatactggcttcttagaatgctaagtgtttgaccccaaaatcctcacattttacaacaagtaaatcctttgctctagaggaaaaaatatcctacaagtcttcagggaactgtcttctggtttagtagaggatgaagattttctttcttttttttccccccccatattcagcttgaattgcagtaacataattcattctcatggcctttgcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatgaaaaaaaaaaaaaanaaanaaaanaaaaaaaagcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgagactcccagggaagcagatgagagtgcatggtttgtcagcccatgtcttncccacagttgtatctgtacagtctaatccaaggaagtaagtttgaatgtgacctgttatttacttcactgtttagcaatggtcttcaggtcatgtataatatactcctggagtttgttcctca

SEQ ID NO: 389828 - DNA, 490 bp, Homo sapiens
tgctggcttgctgaatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctggtaagtttcccgaataacatcaaacagtttaccctaaagcatgatatgct

SEQ ID NO: 389829 - DNA, 3983 bp, Homo sapiens
  misc_feature (2963)..(2963): n is a, c, g, or t
  misc_feature (2967)..(2967): n is a, c, g, or t
  misc_feature (2972)..(2972): n is a, c, g, or t
  misc_feature (3860)..(3860): n is a, c, g, or t
tgctggcttgctgaatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatgaaaaaaaaaaaaaanaaanaaaanaaaaaaaagcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgagactcccagggaagcagatgagagtgcatggtttgtcagcccatgtcttncccacagttgtatctgtacagtctaatccaaggaagtaagtttgaatgtgacctgttatttacttcactgtttagcaatggtcttcaggtcatgtataatatactcctggagtttgttcctca

SEQ ID NO: 389830 - DNA, 844 bp, Homo sapiens
aagaggccctgctgtcccctgcctgcttccagggggtgggccagtgaactcgtagaggcaggcatctcgtcctttcttgcagctgtgacgggccaaggaaagaggggatccagcctcctccactgctcctctgctcctctgctcccacctggctgtgaaacctggggcgagtcatacctgcccctggccttgtctgtgagggactgggctggtggcacctaaagcccttccagttggggccgtctctgttgcacctgccctggcctcccctccagccctcccgagaagcatgctacccaggattacgcttttgtccccgcttcaccccatgctgtccgagccctgaagagacttcctctgtgtctagtcccaagaatagagttctgtcaaggacctccaagtcaccccttgctggaaagagagcattcttgagtgtggccgaggtcctgcttatcagcacagcgagtccactgccccagcccctggggctgctggaatgcaggagcctcccacccggacagggtcagctgctcacggctcccacagtagtccctggaatggagtgcgggagggagcactggtgctgagggcaggctgatcccagccactgccttccgacagggagtggccaggagcgaggctgcagacacagttttgttgcaccccagctggcccaggatgtgtgtactggcagccagtcctgccatccaggccctgggcttgctccaaggctgccagggtaccgggagctgtgttctgctcatgcaccagccttcaacatttcaccttgaccagtgacccactggatcttctcagggtcagggcttagccctgggggtctcca

SEQ ID NO: 389831 - DNA, 460 bp, Homo sapiens
cgtgcatagtttaacagagacgaataatgttcattttgatctttattaagaggtggcctcttaataggccacccccttaataggcctcagaatatctgctttaaagtggctttttcctgatggtttcttctaccattgttacagtagctgcctcaaatcagccaaagcagaagttcctattttgcttgagagcttaggcttcaggcaaaaactactgacatttatgagatacctagtattttacaatgctatctggttaaattcttataattgtccttttaaaaagacagagaacacagaggtaaaataactgctctgagttcacataggcaaatgttggagacgagattcaaacagaaactagactgactcaaaaatcaaatctaagtgatgaaagtaaaggtactgttttgtttgcatcacttaataattcatctggaatcacaagtcatgataagaa

SEQ ID NO: 389832 - DNA, 603 bp, Homo sapiens
ttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtc

SEQ ID NO: 389833 - DNA, 315 bp, Homo sapiens
ccccatgcactagttgtcagtgctgtccagctcgtcagtgtcacccctcctcgcaactccaggcgctcgtttttctgctccatacagagctccggggccattttccggtacttccggaaatcttccatcagggggcgccttctcaccatcaagggaaacaaggccttgagtctctgcttatgtgcaagactctaatccaagtgggaagaaaatcactctctggccacaaaaccagacagcacttacaaatctttcttcagaagggcccattttcccaaattcaaccaagacagatgttcaaactagaacacagac

SEQ ID NO: 389834 - DNA, 724 bp, Homo sapiens
gcggatcacaaggtcaaatcaagaccatcttggccaacatggtaaaaccccatctctactaaaaataaaaaaaattagccagctgtggtggtgtgcacctttagtcccagctactcaagaggctgaggcaggagaatcacttgaacctggaggcagaggttgcaatgagccgagattgcgccactacacaccagcctggcgacagagcgagactccatctcaaaaaataaataaataaaaagggggggtctatgtgacgaggagccttgaagcgttaagtgtttatctgcagttttattttattttggaatgcctaagtatgattttgtgaaagctggtatacaaataaatttaggaataaacctagcacatttatgatacagtttgacaaactgatcaataaaatctatcagttcattttgtaatctataactaagataaattatcatgataatgaaaaattactaatatatatagctaataactttttgcaggtcatttataaataggatatagattaaactatatttgttagattaatgatatatcacacttgccctattatcccaaagttttatcactttaaatgggatttctctatactacttctatttaaaatagtactattcaattatttgtgaatgtctttaaccaatacccaaccctcaaacacaaaggtgaattatttctgagagaagtaagatatagatgaaaaatatgcatt

SEQ ID NO: 389835 - DNA, 270 bp, Homo sapiens
ggcatgcagcaaatccttatggcctagaacggaatttgttagaatttcagccattacatccatgtaaggaaaagaagtcaaaaactggatgtaatcttttattttcaaggtcctcctctctgagatagagccaccttctataaatgggaaaccaaggcccagaggacctgggatgattccagctctttgacttattagccacgtgaccctcaacaaacaatttaacttcttcgtgctgaaatttcctcatctgcaaaaatgggtaaaatg

SEQ ID NO: 389836 - DNA, 463 bp, Homo sapiens
tcaatgaatatctcccccaccctgcacacttttttttcattttgttagatttctcaatgttcccgtctgttaagggaatcctgagtccaaattctttcagggtatttgtaattccaccctgttgtctcatccatgcatttcagataccaccatttgagttcttctccatgtcacacacacataatgttgaaagtgacagggctgagaatgaagtcctgaaaggacacacacaaacataaaccctcctccacctgcctgcatattgatatcaatccattaaatcagcagtctttgactaagactctaattgtactattaactaacctacatattctatcttgtctagaaggattttatgagagcttccacatctatgaagcgtttccttacatggcaccacctctacccaggcaggactggactaatcactcccccatctttcttacaactgaaccttttctca

SEQ ID NO: 389837 - DNA, 140 bp, Homo sapiens
tgtgggacagaatattgacctatgagttttactgaattcatgcaagaatgagccatgctaaaactgggtgaaaatgtagtcatgagcctaagaaaactccaaacgaaatatcactccgtttttattaagttcaggttagg

SEQ ID NO: 389838 - DNA, 255 bp, Homo sapiens
ctaaattctgatcagctgtcttgttactttccttctctgcctcttccatttgctgaaatacagagaaagggccctggtacttggcagacaggcaccactcagtataactggagacctttaggaaatgcaaggcacctccaaacctagagggaaagtttccagcacactgcaatgagcatacttatttccttttccttttattttagagcaccaataattagaatctacatcttctccataccacccccaccaaga

SEQ ID NO: 389839 - DNA, 418 bp, Homo sapiens
ctgcccttagccctctggtcttacttctgtagtaaccctggcaatcttgccattcttgactttgaaatgccacttatgtcagtgactccaaatctgtgtatcactggactttattccacatttttagccctatactgtctttatcccaagtcagctcccttcttccattcccactccacacagttcagagctgattgtgctccctcctttccttacttctgtgacttcctctgtaaagtaaaataattgtattatcatccatacatttgatgattcaaaattacagagatattcaactttgtattctatttggatcacagcaggtctcagaaaggaggtgtttagtttgaagaagctcatcgggataagtgagagggccagcagtctagacaaataaaatgtgccaaagcattgagac

SEQ ID NO: 389840 - DNA, 105 bp, Homo sapiens
ctgacctgtctaggatccctgagtccaggtccggcgagaaactccacagaaaggagggctgtcattcttttcctgagcatcccaaggatttcagagccagcccag

SEQ ID NO: 389841 - DNA, 765 bp, Homo sapiens
ataacattttgacccctatctaaagcaacttgtaatttataaaacttgacattgcttatggctgcagggactatgtgtagtcataaacagttacttttccatgagtaatttatgaccactgaaatgcaatgcacatttgagagtaaagaaacaaatattaaggatgatagtttctaagacacatgcctcctattctcatcttttccatgtgccacagtgtatgtttctacttcttatttcaaggttgaagtggccttttgttaaataaaaagagttgtaaaaagtagaaattgactgactcgcaaatggcatgtccagttacctcccatatgacatcccatgacagctcctcctttctattatttctgcatcttatataggacagcctgctacagggtgtcatccaacaaggcctacaatcctaaaacagaacgttaactgggctgatgcctccatttgggggaaataccagaatcctcacaggtgttcgttcattaagaaagaaacaaaggtccaggcgcggtggctcatgcctgtaaccccagcactttgggaggctgaggcaggcggatcactgaggtcaggagttcaagatcagcctggccaacatggtgaaaccttgtctctactaaaaatacaaaaaaattagctggacgtggtggcgcatgcctataatcccagctactcaggaggctgaggcaggagaatcgcttgaactgaggcacaggttgcagtgagccgggttggtaccactgcactccaggc

SEQ ID NO: 389842 - DNA, 214 bp, Homo sapiens
attttcccttcctaatagccgagtctggcatgctgtcgaagagtgtcacgggtaggtgctaagttgaccttgtaggtctgttttccatcctgacacaaaggggctactgggaagtttttagccagctatgatgacagggagggaggagttcacctgtggacctggtaggggcatgaacgagaaaggcgggttttcaaacggagctaggacagga

SEQ ID NO: 389843 - DNA, 223 bp, Homo sapiens
actgacttttcagggagaaccaactacaaatgagatgcaagtccacgacattagctgtttccttgaacaagaacttggcatatttaatggtgactttggtccaaaaccaaaataagtattatacagtcaagttgcatttgttcaccatcattggataactggctttccataaacaaattaattgtcaatgcaaggccaggcgcagaggcctgtaatcccagca

SEQ ID NO: 389844 - DNA, 659 bp, Homo sapiens
cttcagaatagcatgtgctaaagattctccatgtttttgcacaatcagttcctctgcctaaaataccttccagtcccctaactcctgcccctccatacataccctcaggtaattgttaattattcaaaacccagatgaaataacaccctttctttgctcccacagaacagtactttgtaattttcctctattataactcttactctatttgttatagttagtttgtactctcaatccctagttcagcctctggtcaatagaaggtacctaatgtttggttaatgatgcgattaaatataatcagctctgaaatgtgtttccagtgttaagaactcagctatcttatgtgcataggtacaatatatattttgttaattgaatttgtatttgttctattgatgtcattaaatggatctgcgccagtgacaattatacgtcttcctggagagcaagtacagattcagggggtcatccagacagcccagtcttctgtaattcacccaccacatgtgcaaatgatacagaaatttgaagacttagtggtcgagagttggaacttttataccctgagtcttcagatacatttcagttgctgtacctataatatataaaccaagataaagttgtcttacaaattagactgcagaccaaatcaggca

SEQ ID NO: 389845 - DNA, 699 bp, Homo sapiens
gttggtgtctggagttgggagagaccagtttctttgagcagtggacttcttcctgttggtttcagaacacaggccctatatcatattttgtttaaagtaagaggtctgctgcttaaaaagaaaaaaatttttttccaacacagcttctagtgtaaatggctttttgtgctaggcactatataacgtgactttaaagctggcataattccccaaacaatgaaagcttctggtgagaagcacgtaagtgttgagagaagtgatacaccaagaggaggcccaggttcacactcgacgtaagtggcagagctgggattaaactccttgtctgctacctccagagtccatatctctctcctcaccctgaaatgtaagccagacataccagcaggctgccaagtcattttaattcaaatttgatggagctgccacagcactggtattgctttgttcgagtttgcttcccagatgaccttgctgtgtgtttagacacctttgacagcccatattgaacatacctaaaatggtcttcactgtaagagttcattgattgtgcctctgtatgttcagagtgataatgttttttaatcagagggcattttatttggaatttcttttcaaaaagtgcaggtagttctaaacactaaatacaaggtaaaggttttttaagaatgtgcctagaaagtattgctcttggcccaa

SEQ ID NO: 389846 - DNA, 468 bp, Homo sapiens
taaataaataaataaataaatgtggaattaacaaataaatgcactaataaacaatggaattaaagtctctgggttcacactcaaatgggtggaaaacaaatacacaaaacagtatattattacatggtaagttaaatggtttatgcaaaaaatattatgaaagttttaaaagaaaacaacacttcagtattcagtctgataaaatcctgctatccagacaaagaagtaaggaagtctttctcaacaaagttggagccggccagatgcggtggctaacacctgtaatcccaccattctgggaggccgaggcaggcggatcacctgaggtcaggagttcgagaccagcctgaccaacatggacaaaccccatctctactaaaaacagaaaatcagctaggcatggtagtgcatgcctgtaatcccagctactccggaggctgaggcaggagaatggcatgaacccaggag

SEQ ID NO: 389847 - DNA, 263 bp, Homo sapiens
tttcaggagtgtatatgtttgttgtgtaagagcttatattggcagagaagtgcaaacttcccaaacctgactgcattcaaattgtctgtaaaagatggtccaaaaacatcatttctggtctatacttgtggtgaagccagtgttgcaggtctgatgtggggacttggaagtgaggtttttaacaagctccatgagtgtttctgacacactgtaagtttgggattcattgttaaagtggcaacacagccatgaaaataatgtgc

SEQ ID NO: 389848 - DNA, 209 bp, Homo sapiens
aggccacagtggcaggctgctggcaagagcaggagggggttagagggggacgggacagagagcaggaagcccaggccatgctgaaccacctgtcacttgtcattgtcatcattgtcaagccttgagtgttgcttcctctgatggccatgaagccatcgcagggctctgtgaagagtgatgtgatgagactgggcttgccggccactggg

SEQ ID NO: 389849 - DNA, 781 bp, Homo sapiens
atttactactttaaaaatggaaataataggtctttggtaccttcttgaaggtcatatgccacaaagaatgcaaaaatacatgaaagtccttagtatttgttgttatggtcattttttagagctaattttatttttaatcattagcggttgcttcgtttggagttctgtttttataacaatgatagataatatctgcatcatattattgatgtaaaaaaaatctacctttgaaatgaattagggatgtaccatacttttgaatgtttgtcatcaaacaacatttagcataaactgcatctagtggccattgctctgtaatatgtaaagacttgtcggtactttgtcctgctaattaatttgaggatttagattgtaagctctgtgagggcagaaagtaatatttttctcatttttgtaatcttttctattattgtctgcatagcatagtactttacactgtatcagaaattgagtattttggtttaggcttctatggtaatagaggttaagaaaggaaatttggtagacctttaacatttgctggattttgacatttttgatttttgactgaagtcttcaagttctgttacatgacacaagaatgtgaaatgattttttctttttttgggaaaagctggttttttgtgtgctttatataatttaaagaaaagacttgttatgaaatagtttcagtcattttctgaattattgttgaaattagtacagggtagattcacatggtcagaaagtgtcacttaaagttttcacctttagcttatgt

SEQ ID NO: 389850 - DNA, 234 bp, Homo sapiens
gggtaaaatggggcacaggcttagaattcatgatctgtctgtttctttatgtgaagaactagtgttgtcaattgaaacctattttattttcatccagttgaagcatcttacctagctattcttcttttgaaaagtctagacttcttttctaacatataatgcaaagatctgtttcttttagcattgttttgcatctaggttaggaactaaattagctatgaatttggggactat

SEQ ID NO: 389851 - DNA, 544 bp, Homo sapiens
gctaatttttgtatttttagtggagacagagtttcactgtgttggccaggctggtctcgaactcctgacctcgtgatccacccaccttggcctcccaaagtgctgggattacaggcgtgagcccctgtacccggccaagggggacatttagataattgattttaaccctttcttcctttagtatttacacataagtatctttctaaatcctgttttagctgcatctcataaatttctatatgttgtgctttatttggtttgaaatgttttctaatttcccttgtgatttcttctttactgtttaatttccaaatatttgagacttttctagataacttactgtactgatttctaatttaatccattgtggtctgagaacatgttgtgtaaagttttcagtcttgaaatgtattgagacttaccttatggtccagcacattatctatatggatgaatgtttcatatatacttgaaaagaatattttatatacagttgttgaatatactgttctgtaaatgtcaattaggacaggtagttaataat

SEQ ID NO: 389852 - DNA, 316 bp, Homo sapiens
tttaaaaaattctgtatagaaatacttttctaagggatactgaacagtcaaagcatgtttgatctctctgactttccctcattgaaagcattgattcttgttatacgtggttggtagatttagggagatgtaaactctgaaagaaacttgaaagtaataaatcctatatctcctttatgattatgtctcctttttttctaccccttaaacaacacacacacacacacctttagctgtgctggacacattatctaattccacgtgcgcaaattctgcatctagataatgttgtcttgtgacagtgtggtatctacct

SEQ ID NO: 389853 - DNA, 1223 bp, Homo sapiens
tatatgaagactcttttctttgcataaaaagcattaggcgtataaatgtataaatatattttattatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtataattttttaaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgggtggggatgcattgcagaggcagtagtagcatgggggctagagtggggagcgagatggaaaagggtggggggataggagaattctagagtgcttccagcatgagggtcctgagaacttctgtcctgagttcagagaaacatgcaaagtaactaacaaaatcgctacttgcctttgcagttttacagacccagggagctgctttgggagtgagaaaggcaaccctccaatgtgtttcaactttaaaatgttgaattcttttcagacatgtggtatctcatttattctccttttctagcgtttgttgaatttcaggcagaatgtcttacagaatgtcctagaaccagattatcatttaatccgaaacagctgaggaagggacagagaaggtacaagggcaaggcagcataaaacagatcaggagaatgaagagggaatgctttggttttttgttctgttttgttttttctttttcaagtaactaaaacagcatctccactcattgcccaatgtcactaaagggtttagttttaaggagaaag

SEQ ID NO: 389854 - DNA, 731 bp, Homo sapiens
ctgctttgggagtgagaaaggcaaccctccaatgtgtttcaactttaaaatgttgaattcttttcagacatgtggtatctcatttattctccttttctagcgtttgttgaatttcaggcagaatgtcttacagaatgtcctagaaccagattatcatttaatccgaaacagctgaggaagggacagagaaggtacaagggcaaggcagcataaaacagatcaggagaatgaagagggaatgctttggttttttgttctgttttgttttttctttttcaagtaactaaaacagcatctacatgtagagtgtcgtggagagctgagaccagggtaaagtcaagtgcagcatcagtactgcgagacccaccagcccctggagagggtcagctgagaatctggtagtgaagcctgtgtagggtcccggcaccctcaccctcagccacctgcagagaggccagggccccagagactagcccggttctgaagtgggcaggggtgctgccagagccttccgccccttatattgagaccctgctttcaggacaggccagccgttggccaccatgtcacattctgagtgagtgtcacgggtccctaacaataattttctgatctggagcatatcagcagaatgcttagcctcaaggggcctggcagctgtaatgtttgatttatgatgagaactatccgaggccacacttggcctctaaataagctgctctagggagccg

SEQ ID NO: 389855 - DNA, 392 bp, Homo sapiens
ttttaatatagtctgtatattttttaatattttgtatatttctgtgtattttaagtattttagtaccacattattaaaaacatctctgtggcaaaaatcaatacaaaaccactggtttttttacccattatttttcaatcttattctatcttcagaggtttaacacacaactacacaacttctctagagcaacttgtattaccatttctttctccaatctatcttcgatttacatcacctagcaaggatatagtcttcatgatattttaagtatatactttccttctttctctttctttgaaagaaagagaaagaaggaaggaaggaagggaaagaaggagagagagagaaagaaagaaaaaagaaagaaagaaagagaaagaaagaaagga

SEQ ID NO: 389856 - DNA, 179 bp, Homo sapiens
accaatttgaaatcaagacttaaaagttgcaaggcaataaataaactgtattaaataccatattttgctgccatcaaaataatttataaacaactacaatacacaattaaaaatataatttttttctgaaatgtgtggaaaggtgggtggagtggttcttaccttgttttagagggtta

SEQ ID NO: 389857 - DNA, 407 bp, Homo sapiens
ggtaatttaaacagagaaataaatcttcttccaagcacagagagcttcatgtttaaaattttagatgattgtaataatcccagtaacagaatataatgaagtgtttcccagcacactttagagaagacatactgagtattatggttctgttcagattttattttctgggactctattttaaagtgctccatctgtatttaagaaaacacatgcatgcacatacatcctgtggcactctcttctagggcaggtgttggtgggtaggtccctgtgcatttgtttgggggacacgtttgacccagtggtgtaatagttgttacaagaggattctctggaggaaggctgctgctgcagaggaggaagtcacatttgtcttctcccaaaacatcaactcattgtcttcctag

SEQ ID NO: 389858 - DNA, 344 bp, Homo sapiens
attagcttttgtatttctatggtattggttttaatatctcctgtttcatttctaattgagcttatttggatcttctccttttcttggttaatcttggtaatggtctatcaattttatttatattttcaaagaacaagctttttgtttcatttatcttttgtattttttgtttcaatttcatttagttctgctctgatctttgttatttcttttcttctgctgagtttggggttggtttgttcttgtttctccagttatgtgtggtgtgacctcagattgtctatgtgttctcttccagactttttgatgcaggcattcaaggctatgaactttcctcttagcac

SEQ ID NO: 389859 - DNA, 830 bp, Homo sapiens
aaataataagtggtggtcaagtcactagttatctaaacttagtgacagggagtctaagagttgccatgcctatgcaaattcagtaaagttaaaggcaagtgcaatacaaattatattcatcttagcgcacatcactgcccaggatttcataaacagatacctcaacttgttagatctactctttaacatctatttcattttttaaaaaatttcagtaaagaatgctgttcataatcttgtatatttgtttaaaaccccactaatcgggtgcagcctgccatttgtaaaatactgtgtgtgttgggagtccccaagaccacctcaggtttgattattcactaaaaggactcacaggacccagcatatagttctacagctgtggacatattacaatgtcagggtacaatgcaaaatcagcaaaaaggggagggcccatgggtcgaagtctgaaggaaaaagagtcctctcccaatggagtcatacaggacacagttgatcccccagcaatgagctgtaacaatatggtcatgtgccacataatggtgtttcagtcaacgatggaccacatatatgacatttgtccagaagattatagtggagctcagaaattcctgtcgcctagtgacgtcataacatcctagcgtatcctaggtttcaggtgtttgtggtgatgctaatataagcaaacctgtgctgtcagacatgtaaaagtctagcatgtgcacggtacatataatacttgataataaacgactctgttactgtttaatgtgtttactatactatactttttattcttaactttagaatgtactccttctacttatttt

SEQ ID NO: 389860 - DNA, 400 bp, Homo sapiens
aagagaccatgaaagcagtcaggggagggctcaggtcgtcaggcgtggaggacagggggcctggctcaggcatccggggcccacgtggctgggaggccaccattgggtgggtgtcagctattatggccgtggcaggctagggactctcactgaacgcctcctcccaacaccaacctctcaggcttgggagaactgcccccactgtgccgctggagtcagcgctcccacaggcattcgggggaggccagggctgaaggggaccccagggcccacctccaccttttgcaaggcgaggcaagggtctggaatgctcccaggtggatgtggttgggcgacagcctggggtctgtctcataagctcaggtttggaaaataagaccatccactagctgttagcccc

SEQ ID NO: 389861 - DNA, 762 bp, Homo sapiens
gcttccagcggacggcagcgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccctggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacaggtga

SEQ ID NO: 389862 - DNA, 818 bp, Homo sapiens
gcttccagcggacggcagcgcgcgagaccaggccaggcgtcaaagcaagtcacccatccgacctaaacccctctaagaccctggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagggctgcacttcctgctttcatccagaccaagttcggatcaagtgggagttcttcaaagagagagtttgcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatggtg

SEQ ID NO: 389863 - DNA, 1170 bp, Homo sapiens
  misc_feature (2)..(2): n is a, c, g, or t
  misc_feature (4)..(4): n is a, c, g, or t
  misc_feature (11)..(14): n is a, c, g, or t
  misc_feature (21)..(21): n is a, c, g, or t
  misc_feature (34)..(35): n is a, c, g, or t
  misc_feature (37)..(37): n is a, c, g, or t
  misc_feature (60)..(60): n is a, c, g, or t
cnanttttaannnnttaaaantagtttgttaaanntnatgttatgactagtcataacatnataatttaactcccttttctttttattttatttcactggtgaaaaaagaggctgtaaaaaataaaatgacttctattacctcaagttagtgcaaggcctaggactaaaaattagtaatttttcactcttgaggcagtgctctgatgatgactacaatgtgtgtctcatttacttctatcgtaatcctttttttaatatattttagaaatggttttgttaaatgttgctaaaacactggtaaatgctctttaattttctttatatgcagaatgaaggttttttattgccagtgcaccttaatatatgttcactgataaataaaggaaaatggttataatatagggagttgggttctgtgtaataaaattgtattttttgtcccttaaaaatgcccttaatctttatcataagcaataatagaaactattgcccatgtactttaatgtattttctgtaataataaaggaaaatggttgtaataaaggaagttgggctttgtgtagtaagttccaattgttttttgtctaaaatgttcttggtatttattataagcattaataatagaaagttagacctccttggtattggtactttagagaagggtcactgttgagtcacttccagtttcctcttctcttagtcttgacagcatatggaaagctccactaacaaaataaaacttatattatttttaatgactttttttttctcgccacaagtaatctatatcctgatgtatttgaagtagagcagaaatacaaattatttaaatgtgctgatgtaccaatggactagatactgttttcttctatgttattaaattataaaataatatagtaagtaaatttaaacagtgtatttgaaaatcctgaagtatatttattatttgtctatttcatttgggtctaattattgtaatcatttgatcatgatgcaacaagtttgaaaaataatagaaaaaagtcagatgggggccgggcgcggtggctcacacctgcaatcccagcaccttgggaggctgaggtgggtggatcacgaggtcagtagttcgagaccagcctggccaacatggtgaaaccccatctctactaaaaataccaaaaaaaaaaa

SEQ ID NO: 389864 - DNA, 401 bp, Homo sapiens
tttcctgggttcaagtgattctcctgccccagtctgcctgagtagctgggattacaggtgcccaccaccaggcccagctaatttttctatttttagtagagacagggtttcaccatgttggccaggctggtcttgaacttctaaactcaggtgatccgcctgccttggcctcccaaagtgctgggattacaggcatgagccactgcgcctggcccattgcaatttatttgttaaagaaactgagtcctttgttccactgagttacattgcatccccatggtgctgttcaatatatttatctgtcccctttatttccagtaactggtagttaaatctagaggcttgatctgattcaggtttggttctggggtcagaacacttcaccagtggtggtaggtatt

SEQ ID NO: 389865 - DNA, 322 bp, Homo sapiens
atacatactaaaaaattcttttggggcatatatgaacaaaaaatttgaaggtcattctcctgtaagactcagtgattcccagtcttgtcttttcttttttttgttggcataatagcgtacataagaaaaatgagatatggaccccaaacagctaaaacaattttggaaaagaagaaacaagttagaagattcacactttctgatttcaaagcatattgcaaagctgtaataacccaaactgtatgatactggcataaagacaaacaaaccaatggaatggaatagatagctgataagtaaaccctcacatacatggtcaaga

SEQ ID NO: 389866 - DNA, 282 bp, Homo sapiens
cctaatatattctttacttagattctattttgttagttactaagatcactatccagcttcctttcaaatcatatttacctgatacactcttccatcctttatctgcaacctttctgtgtgctttcatcccactcttcctaccctgacagtccccaagcagccactgatctgatctactccctgtcactctaggttagtctgcactttctagagttgataaaaatgaaatcatacagtatgcactcttttggaggaggagaccaggcttcttttactcagcat

SEQ ID NO: 389867 - DNA, 335 bp, Homo sapiens
gttgtcaatattcaatgttatcctaatcctgtcctatataatttttttatctattcaacaaatgctattaattgagcaccaaggatacctccgtgaacatgaaagacagtctgcaccttcatggaactcacagttgcttggatttaagatcaaacaaataggccaggtgcggtggctcatgcctgtaatcccaacactctgggaggccgaggcaggcaaatcacgaggtcaggagatcgagaccatcctggctaacatggtgaaaccccgtctctactaaaaatacaaaaaaactagctgggtgtggtggcgggcgcctgtagtcccagctactt

SEQ ID NO: 389868 - DNA, 353 bp, Homo sapiens
gcctcccgaagtgctgggattacagccatgagtcactgtgcccagcctataattaagtttttaacacaataaatctgttttactgcaagaattaatagaattggcctagcacgtggcatgccacattccttcactggggggggctgctatattattactagtcctatcactggtactgtaagacatagaactgaagtgtttgttacacgaagaaacaagaatatgccaggtgcggtggttcacccctgtaatcccagcaccttgggaggctgaggtgggaggatcacttgagctcggaagttcgagaccagcctgggtaacatggcgaagcctcatctctactaaaaatacaa

SEQ ID NO: 389869 - DNA, 219 bp, Homo sapiens
ggcctccaagtgctgacacggccttctgcctcccctttaatgatatagtctgagaacgtgaaacaggtattgttttagcctactatccgttcactcacatttactgaacatctactaggtgtcagatactggggctatagcagtggagacagacaagatgatgtgtttgagggaggatgggaaggaacagaagtgcttctttaaaagtgatgacattgg

SEQ ID NO: 389870 - DNA, 6097 bp, Homo sapiens
  misc_feature (816)..(816): n is a, c, g, or t
  misc_feature (1379)..(1379): n is a, c, g, or t
agctctgctcatgtgctttgcctgctttcccatggcaggctttttattggttaaataaagacacaaacttttcatcagtctttgcaaatacttggttccggcaagttcttggcccttcccaggcttggggctgccggctcacggttcttctctctgcatttcagccaggcccccatatgctgggtttgcaggtcacgaccacccatgacggctgtgctgcgtggggtgcagttccccgtgggcgccgagggtggtgtggggctgcctctcgctcgctccaccagccacccgagggcccgtgtcctggtcgtggccgcgtgtgctctgctgtgtgggtggtcagtcctccccaggggccacctggatggtgtccactcctgccccatggcaggaagtcccagcggcacctggccacgtccctctaacatgtttctggaagtgggattctaggctggagcctcatagcgggcagatactgccccctggccatgagccatgacagttggttgatgggacttgaaggggcctctggacagtgtggctgcagccctggaccctaggagaatagcagccgtgatggggggcagggaccccactttctgggtgggagtgaggagggccggctgctgccccttgctgcagtcatcttcagtcactttcccggccgccacggccccctcctggcttcttgctctcagcagaggggacaagacccttgtgagggtgggcacaggcactccaattgtttggggccttcgctgtcccttgctgtctgtgctggtctttccaggcatccccaggccgtgtgtgtcagcnggtggaggctgggcacctctcacccacccaagctgaagcggcctcacagggggtggcaccaggtgtttctccagctgaacaagctcgccctggaacccccaccctgaaagggctactgcccccatgagaggagcttctagagatggtggccagccttgggggcccggtggagatgtgttcgcggggtcctggtctgattctgtcttggaaggaacatcgggcccctgagaggtcagagcagtggccggcccacggctccgctcaggcgccacggcggctcctttctgtttcttgtagtcactgagttcgaggttcccacagggaggaggcttcctgtggctccgccgtcagggagcagtggggctgccccagcctctgggggctttttaggtgctctgaggcgatctgggtgtggcctggccggtgtgggcagctttgcccttcgtctgagaccccgagccctggggcaggatgaggggtgtggggagagtttgctttttccagagacgtttatctgtttttttttagacggagtctcgctctgtcgcccaggctggagtgcngtggcgcgatctcggctcactgcaagctccgctcccgggttcacgccattctcctgcctcagcctcccaagtagctgggactacaggcgtgtgccatcacactcggctaattttttgtatttttagtagagacggggtttcaccgtgttagccaggatgctctcgatctcctgaccttgtgatccacccacctcggcctcccaaggtgctgggattacaggctgagccaccgcactggccagcgtttatctttaaatgtgccttggacctggcccctggctctttgggagggagagtccttggcaggccccgttgcctccaccccaccagtgcaccttggctcctggtcactgcccaccctccctgcccgggcaggaattcttacaggccctacactcctgaagggaaatcaggctggtcctggggcaggcagcctctcagagctgttgagaattgagcaatctccttgtgctctttcaagctgttcttttctttggttcacactgagcaagggctggttgctccgatagggagaagacgtgaggagtggcatttactgtgattgagcacagggcctgtggactctcccattcacgcagccacatttcccaaaaagaagtggtcctgctccccaccccccgacccccactgcagcgccacctgcctttatctgtacttggagggacagcgcacaggctgtggctggctaccccaggtggctccacccagctctcagaagttcacctgctgcactcagaggccgtttacttgaggtttgatatttatctccaaaggaagggctgccccgactggcctggaccctccagggagttcagcaagccggaaatgcgtgtctgctgctctcctggcccctgggccacctgcttctgtggccctgggattggggagccagggctgagggcctgtagggccccctgtctgtgcctctagaggccctgagccacctcctgcagtgttttagatcccataagcaagagacagaattgtgcatggatggtgagaaaacatgaagctttttatttgtaaacagaaaatggcagggctcactgtgtggggctggggacagcgctaggcctgctttaggccgtgcaccccaacctggggtgttccaccaagaggggtacagtggcctccactgtgagtatgtggccatcctctggctcctgattgctgagttcctgattgctgtctttgcgtaacttaggaaccccgatgaagagcccgtgctcatagctccgttcctgacatgttcaggaacgcctctgttgaggtttttctctttggttctggaattcctgggtccctttgacccctgatgcgtttgttttgggtgttgatgagcactggagctgcttccccacagggatggggcattggggagattccgacacagcagggccctcacccaggaggctgctgtgggtgctggagcggttgcttccatggagctgggattcctctcatttggggctgtaggaaggggtctttcctctctgtgctaacagttgtttgtttaaaaagaaaggctgtttaaacctttcaaacttaaaacttctttttttctttggagatggagtctcaccctgtctcctcccaggttcaagtgattgtcatgcctcagcctcctgaatagctgagattacaggcacatgctaccatgcccagctaatttttgtagttttagtagagacggtgatatggtttggctgtgtccccacccaaatctcaacttgaattgtatctccaagaatttccatgtgttgtgggagggacccaggggaggcaattgaatcatcgggctggtcttttctgtgctattctcgtgatagtgagtaagtctcatgcgatctgataggtttattaggggtttctgcttttgcttcctcctcattttttctcttgccgctgccatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacgggctgggtgtggtggctcatgcctgtaatcccagcacttttgggaggccgaggcgggtggctaatgaggtcaggagttaaagattagcctggctgatatggtgaaaccacgtatctactaaaaaaaaaaaaatacaaaaattagccggcattgtggcaggtgcctgtagtccccagctacttgggagggcgaggcaggagaa

SEQ ID NO: 389871 - DNA, 5090 bp, Homo sapiens
  misc_feature (816)..(816): n is a, c, g, or t
  misc_feature (1379)..(1379): n is a, c, g, or t
agctctgctcatgtgctttgcctgctttcccatggcaggctttttattggttaaataaagacacaaacttttcatcagtctttgcaaatacttggttccggcaagttcttggcccttcccaggcttggggctgccggctcacggttcttctctctgcatttcagccaggcccccatatgctgggtttgcaggtcacgaccacccatgacggctgtgctgcgtggggtgcagttccccgtgggcgccgagggtggtgtggggctgcctctcgctcgctccaccagccacccgagggcccgtgtcctggtcgtggccgcgtgtgctctgctgtgtgggtggtcagtcctccccaggggccacctggatggtgtccactcctgccccatggcaggaagtcccagcggcacctggccacgtccctctaacatgtttctggaagtgggattctaggctggagcctcatagcgggcagatactgccccctggccatgagccatgacagttggttgatgggacttgaaggggcctctggacagtgtggctgcagccctggaccctaggagaatagcagccgtgatggggggcagggaccccactttctgggtgggagtgaggagggccggctgctgccccttgctgcagtcatcttcagtcactttcccggccgccacggccccctcctggcttcttgctctcagcagaggggacaagacccttgtgagggtgggcacaggcactccaattgtttggggccttcgctgtcccttgctgtctgtgctggtctttccaggcatccccaggccgtgtgtgtcagcnggtggaggctgggcacctctcacccacccaagctgaagcggcctcacagggggtggcaccaggtgtttctccagctgaacaagctcgccctggaacccccaccctgaaagggctactgcccccatgagaggagcttctagagatggtggccagccttgggggcccggtggagatgtgttcgcggggtcctggtctgattctgtcttggaaggaacatcgggcccctgagaggtcagagcagtggccggcccacggctccgctcaggcgccacggcggctcctttctgtttcttgtagtcactgagttcgaggttcccacagggaggaggcttcctgtggctccgccgtcagggagcagtggggctgccccagcctctgggggctttttaggtgctctgaggcgatctgggtgtggcctggccggtgtgggcagctttgcccttcgtctgagaccccgagccctggggcaggatgaggggtgtggggagagtttgctttttccagagacgtttatctgtttttttttagacggagtctcgctctgtcgcccaggctggagtgcngtggcgcgatctcggctcactgcaagctccgctcccgggttcacgccattctcctgcctcagcctcccaagtagctgggactacaggcgtgtgccatcacactcggctaattttttgtatttttagtagagacggggtttcaccgtgttagccaggatgctctcgatctcctgaccttgtgatccacccacctcggcctcccaaggtgctgggattacaggctgagccaccgcactggccagcgtttatctttaaatgtgccttggacctggcccctggctctttgggagggagagtccttggcaggccccgttgcctccaccccaccagtgcaccttggctcctggtcactgcccaccctccctgcccgggcaggaattcttacaggccctacactcctgaagggaaatcaggctggtcctggggcaggcagcctctcagagctgttgagaattgagcaatctccttgtgctctttcaagctgttcttttctttggttcacactgagcaagggctggttgctccgatagggagaagacgtgaggagtggcatttactgtgattgagcacagggcctgtggactctcccattcacgcagccacatttcccaaaaagaagtggtcctgctccccaccccccgacccccactgcagcgccacctgcctttatctgtacttggagggacagcgcacaggctgtggctggctaccccaggtggctccacccagctctcagaagttcacctgctgcactcagaggccgtttacttgaggtttgatatttatctccaaaggaagggctgccccgactggcctggaccctccagggagttcagcaagccggaaatgcgtgtctgctgctctcctggcccctgggccacctgcttctgtggccctgggattggggagccagggctgagggcctgtagggccccctgtctgtgcctctagaggccctgagccacctcctgcagtgttttagatcccataagcaagagacagaattgtgcatggatggtgagaaaacatgaagctttttatttgtaaacagaaaatggcagggctcactgtgtggggctggggacagcgctaggcctgctttaggccgtgcaccccaacctggggtgttccaccaagaggggtacagtggcctccactgtgagtatgtggccatcctctggctcctgattgctgagttcctgattgctgtctttgcgtaacttaggaaccccgatgaagagcccgtgctcatagctccgttcctgacatgttcaggaacgcctctgttgaggtttttctctttggttctggaattcctgggtccctttgacccctgatgcgtttgttttgggtgttgatgagcactggagctgcttccccacagggatggggcattggggagattccgacacagcagggccctcacccaggaggctgctgtgggtgctggagcggttgcttccatggagctgggattcctctcatttggggctgtaggaaggggtctttcctctctgtgctaacagttgtttgtttaaaaagaaaggctgtttaaacctttcaaacttaaaacttctttttttctttggagatggagtctcaccctgtctcctcccaggttcaagtgattgtcatgcctcagcctcctgaatagctgagattacaggcacatgctaccatgcccagctaatttttgtagttttagtagagacggtgatatggtttggctgtgtccccacccaaatctcaacttgaattgtatctccaagaatttccatgtgttgtgggagggacccaggggaggcaattgaatcatcgggctggtcttttctgtgctattctcgtgatagtgagtaagtctcatgcgatctgataggtttattaggggtttctgcttttgcttcctcctcattttttctcttgccgctgccatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcactcgtaaagtgctgggattacaggcgtgagccagctgcacccggccccatagagagatgcg

SEQ ID NO: 389872 - DNA, 2811 bp, Homo sapiens
aggatcccgggcgatgtcgcgtgcatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacgggctgggtgtggtggctcatgcctgtaatcccagcacttttgggaggccgaggcgggtggctaatgaggtcaggagttaaagattagcctggctgatatggtgaaaccacgtatctactaaaaaaaaaaaaatacaaaaattagccggcattgtggcaggtgcctgtagtccccagctacttgggagggcgaggcaggagaa

SEQ ID NO: 389873 - DNA, 469 bp, Homo sapiens
ccttttgtgtcctttcacaatccctcttctgaaaaaatgattatcagaactgtcatcctgatgcttcccttcctaactgctttttatggatgattgtgaccactttttttcgtctgtattcagcagtagtatacacctgtaatctccttttttcatctcattttccttcccctgtggatagaatcatgctcagaaataaaaggaaattaaagctttccctggattctgttattttttaaattgctctccagtggttctttttccagatttctctaaaggaaggctattcccttgctattcagagctgtgtccaaggaccagcacaaacatcacctgagtgctcatgagaaatgcagactcccatacctgctgagtcagactgtgtactttcaagaagcaggaactggccagttcctgcttcttgaaaggcaaggaggaggagactggctcacacctctggaggttggtg

SEQ ID NO: 389874 - DNA, 665 bp, Homo sapiens
taattaaaatatgcataagtctttgaaagatttgtataaattttccacatgggaaagaagttattgtcacagtcagaagagatacaatatgtcatgttctcctgttattgttcgtgactaaaatacaagcaaataatatattctacatatgctatgccacaaatgttgcctctaatgaaatattgactcaaggatatctactgtaacatgtacatatataagaattgataggcaatgaaatatgtgatagttaaagacattatattttaaaaattttttattcttattgtactcccatttcaatcaatttaaagttttaaaattctgagtcatgtgttttggcaatcaaatggtctgtaactttggaaatttggtagcatttccaaaactttgaacatactcaaatgcttattttcatttaaaacaaagattttttaaaatgttgtatagtctgagacaaagacttaattttcagctgactaaaatttgtgcatgtaatttattcatcattgatggaatttaatcagaaataactcaaatatgaatcagaggaagaaataaccaataatatatctaaattaacattgttcaatatagtaatttcggtttttgtaatctgcagacctgttcgccttattcctattttgaaacatgtaggatatatg

SEQ ID NO: 389875 - DNA, 398 bp, Homo sapiens
tctcagtctgcagtacagtggtccccccagaaaccacaggtagtacaaaccctgtatatactgtatttctttctagagatacacctgtgataaatttatcaattaggcacagtaagaggttcacaacaataactgaaatgaaacggaacagttagaacagcatactgtggttgcgcagtggctcccgcctgtaatcccagcactgagaaggcggaggtgggcggatcgccgtagcccaacagcctgtttgttttctctataaaaacaaatcagtatactataatacaaattgtgattgcggtcagaaaatatcttattgtattgtgctgcagataacaaacagcagaaaactaacctttggctaagaggggactattgtatcccttaatctgaattct

SEQ ID NO: 389876 - DNA, 430 bp, Homo sapiens
tgggctgaggcttcccggaccacggaggatccgcgctgtcgagggcaggacccaggagggggaggaagcagaggatgctcggcgccttcttggctccgcccttagccccgccctactgcggcgtttaagggtctcttagcaggtggctacactggatccaaagtcgggggagtgttacggcagggaacactcgcagaccgcctagtctaggccctcattatggggaaactgaggaacagaaaggtcctgtttctaagtcttacattaccaagactgaggtgcgggggcggtcctggatcccccgccccaaggctgggaggggcacgcctcggaagggaggtttggggtcggtggtttcacagtgagtgtgtctgaagccaaatggtcggaaaccgttacccgctctcctaggcccggctagtggggaccc

SEQ ID NO: 389877 - DNA, 849 bp, Homo sapiens
cacattagactcccaagaccacagggcaaaaatccatctctggagcggcttgtaacaacagctcagtccaagccctggcttcttaggtccctattctgacacaaggggatcccacagcacccccaccacctcaccaccatgcttgcggtgctgtgacacaccatggtctgcccttggagcaagtcccaaaggccagcctcatcccttcagaagcttccagtattgaactgaacatagtctctctggctctccaagcccctgtctggcccttttctttcccacttgggcccacatgggcccacatgggctcctgtggcttacttagctgtccctttcactgatgttttttcagggaaggcaaatgcaaactcattttaatcttagtcccataaaaacagactcagaaggtaaattgcttcccacccaggcagctggcatcaagtgcactggcgtggatggtgacatatttcagtgtgcaaatgcacaggtgtggacagcatccatctccatgggtgctgaatttcctaacctgcctctcttcacctcagagaacaaaggaaaagcctccttaagaagagggcttgaggcagggcacagtggctcacgcttgtaatcccagcactttgggaggctgagacaggcggatcactggaggtcaggagtttgagaccagcctgcccaatgtgttgaaacgttgtctctactgaaaatacaaaaattagccaggcgtggtggcaagcgactgtaatcccagctactcgggaggctaagacagggagaattgcttgaacccaggagacagaggttgcagtgagccaagattgtgccactgcactccagcctgggcga

SEQ ID NO: 389878 - DNA, 422 bp, Homo sapiens
gagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctcttctcttcttccagcaacttcccctttcatcattcctttccctggggacttggcattcagtg

SEQ ID NO: 389879 - DNA, 362 bp, Homo sapiens
aaaggggaatgataataacctacaacatagaattgtcatgaagacgaaatgaaaaaatatatgtaaagttatttgaatagctgatggtgcatggcaggcacttaataaatactagctattatcattactgttacaggtctgaaatccagcttcacaaattttgtcatctggtgctatgcaataccaaagaaaaaaaagactacaaccacttttaagcagtgattcttttactctctcccttttaagagacactattctaagatgattgtattaccaaacaaaaattaagtttatttttaaataaatgctttttctcttacttttatcagttctgatcacaatattatgagcacgtcatcata

SEQ ID NO: 389880 - DNA, 440 bp, Homo sapiens
tactgagttaagtaagacaatttgtgtgccttcaaaactcactctagagagaaagaaaggtaggcaatgatatgtaaatatcttgcttgtttaataaaaaactgacaaaggaaagcgtttggaggataaaaaaagtttgaagtccattgaggaaaagaagaaagttacttctgctaacccttcccccaaccctcaaatgacttacaatatggggctggagaaagtgggtgccaggaaaggggcaaaacctgcagccagctgagaatggtggagagacatgaagaccagagagggcactagggcaagttcatccagtgtgaacgtagcccttttaaataatctgatgtatacatatgtaactaacctgcacaatgtgcacatgtaccctaaaacttaaagtataataataaaagaaaaaaaaacttaaaaaataaataaat

SEQ ID NO: 389881 - DNA, 874 bp, Homo sapiens
ggttgcagtgagcccaaatcactgcactccagcctgggtgacagagcgagacacactatcttaaataaataaattaattaaaaatttcctctcttcaaatgtaacaagacacatagggacatgtctgtattttataccacttcataaaatttaacatgcaagactctaatatatgataattcttccctgtgagaaacgtgtgtgtgtgtgtgtgtgtgtgtgtgtgtaaaagattgctgaaaaagataggttagtcctaagatagagctggatatcttgaattaaatgaaaatatacccagacacatctagcttatgacttaagtttgttctgtgtgaaacagaaatgaacccggcatagagtagcgctcacggcgcatatgcagcacagagtgcactcacattttattgcatgtgcaagagccactgttggtctgcattcagatgacccacattttatttctagcagttgttttttattggcagatgaacgtcctaaaatcagcaagttcagcagtaacgtatattttgataattgtgttcttgagtgtcatggtttgttttattgtcctaccgccagtctctgaacatatgaaagacaattagtgaacccagtcattaagcttggagatgaataaattcaagctgaacttcattttgttaaactcagcctgtgccatttggatgtgttggcagagcttggggcagacagccatcagataggaaatgagagctgttagattagaaacaggcccgcccaagtccacttgctaatgtgggtaggaaattatacttggcataggaaacaatcctgaaaatcatacacttagcagtttttattggttctttatgtttccatgactgtttgaggagat

SEQ ID NO: 389882 - DNA, 220 bp, Homo sapiens
acgtcgccgtccccgcgcgcgccctggtaacggcggctcccgcgtcctcctccatgtccccgcctatccccgccgcagcccgccccgtctcctcctccctccgcagcctcgccgagtcctcggtgcgggctgcgagcgggacccgcggagctgcgctgtcctcgacgcctccgccaggcgcgggccgaggagcctccaagagctggcccggcccccggcc

SEQ ID NO: 389883 - DNA, 820 bp, Homo sapiens
tgaggagcggctgggggcgagggccggggaaggggcctgcagatgccgcctccgcctcccttccttgtccggggcccccatggtgtcggggagcaggaggaatcaatcaggataatgaagccgcagcctgccacgcactgcgggggcactgaggagcgggggccggtgccaagtccgccagacggttcggaggagcggagcccggcgcggcccggcggcggcggcggcggcggcggcggcggcgatggcggaaacccgaaggccgcgcgctaaagcaggacgcagctccgcgcagggcgctggcaaccgcgccttggcaaccgggacgcccgagagaaatcttaaagctgcagtggcctctttcccctccattgcggtcgccgccaggaccccaggggaaatggtcgtgcgggcaaaggttgctggtgggggtcaagctctgagcctctcaggacttgggaggccgactcatacactcgctcacttatttattttattttattttattttattttgagacggcgtctcgctctattgggtaagctggagtgcattggcgcgacctcggctcgctgcaacctccgcctcccgggttcaagcgattctcctgcctcagcctcccgagtagctgggattacaggcgcccgcaccacgcccggttaatttttttggactttaagtagagacggggtttcaccatgttggccaggctggttttgaactcctgacctcaagtgatctgcccgcctcggcctcccaaagtgctagcattacaggcgtgcagccgcgcctggccgtatttattaaatgtgtgttgaac

SEQ ID NO: 389884 - DNA, 468 bp, Homo sapiens
gcaaattttatcgtgttgcaccaaaaatatttctaacttaaagcatgatgcacagactgcttctaggaatgaactacaaatacaacaaatatggcattttttttctttttcattccttattgtaatgggatttcttctaataaaattggggtgagaggcgatagccagaattattatcaaatgtaaatattgtcatcactcttaggaagtatctttgtatactttattaccttggtgtcacctgtcttttcagaagaagagtctgcagtagcacaggaaatgttgttagcttgtgtccaatgaatacaatggacatactaccagaaacttgccctgagcttgccaatgaaaacatttattgccatatgtaactgcagcatcattaaaattacttagtctttcttaagtttatcatttagagaaagataaggaaaaaagttggaaattctacataaaatgtaaaatatc

SEQ ID NO: 389885 - DNA, 341 bp, Homo sapiens
gaatttatccattaacaaagtttttagacagagttgtttatatctactcaaggtgtcattatgcacatctgtttcttgtacctcaggttcatcctatagaaaatcatgctaactcacaagtcatgcagtgttttcaaaaagacaagtcatgcagtgttttcaagttcagagagtagcaaaggatgcaaatctaatttctttaccatttgctaccatctgaagttagtaacattttttggctaatcaccaagcacccagaaagaaagaaatagagcaaatttggtgcatcgtttgtcttccgtatctcctttcgaagtcatttccacaggataagtgccaaa

SEQ ID NO: 389886 - DNA, 369 bp, Homo sapiens
taagaaacatattttttcacaatctcccatggacaaaagcactgttatgagaacctgggagtccactggaaaagtgccagcagcccaatgggataaataatccaaaaatagacacactgaaaaaagtaagaagaacagttttactttatcagcatcaccccttttcccaaggcagtaaagctcagtgccaagagagaccctcttaatccatgatttctctaacggagaaaactgaaagcgtagtgaattcctaccttccttaatcatgtggaatgctgtctaagaggcatgccccttccaaacctcacagataacatgagaacagtaggtgtaagtatcctgcagatatttaagagtagaaaaaagaaa

SEQ ID NO: 389887 - DNA, 772 bp, Homo sapiens
gaggcgggggtaggaccttcactgacagactgaggagctggaatttacctagaggcacctgggagccattgagaattttttagcaaagatgtagcacagctacaatcagctgtgtttatttcccagcagaaggaaaatgatttgggggagtctgcgccacacccctaaagattgttcatccttgaagaataatcaagtgattaatgggggttagggaagatgctgtagaaataaattctgaggggggcaaaaagagacctggagcaggggagggaggttggaagagttagacggagaggaagtggcctccaagctgcaaaaaaggctggcagttgcaaacagcccagggtgcatgtgctgagcgctctgtagctactgcccctgtgcactctagaagagctcgctggtgaggtggggcgacaagttgagcctccttgaggctcccacacatggctgtgctacatagacattctgccaggagaagcagcacaaaagacaaaagagattggcttcaggtcagattcatcatgaaagacttcccagggctagtccaggaatccagggcttcagctgatgcacaggaggcgaggcagaggaccagtatgattagggacacaccggctgtatctgaagtgcctggctcccagcccccatcccatcccagatggtgcggcccatcagcaggccatgatggcaccaccataactgggtatcaggcaggaaaccttgcagcagaccagaatgggcccaagattggtgaaggaggaataac

SEQ ID NO: 389888 - DNA, 372 bp, Homo sapiens
acttcctctcattgtactggaaaagcagcgtaaaatctatgtgctgaacctgaaactctcctggcctgcaatccaaggagcctgtcattggctacaccatgtaagtacagtttgtttccaaggccatctctcaccgactttgttcttattaaaataattttttaaataatttttacttttccttcaaaggaagtttttttttagtaaatatgttcatattcccatcataagaagttgaaacaacacaagataaaaattccctggattcttcccagttttcatttactacctctgagataactactattacccatttggagtgtttcctttgtattctttccatatatttacatataaacatatgtgcacttt

SEQ ID NO: 389889 - DNA, 442 bp, Homo sapiens
tgacctcatgatccgcccgcctcggcctcacaaagtgctgggattacaggcataagccaccgcacccggccctgaagagcttttttaaaaactgcccatcccagagacttagtttcatttggtctggggtggggtccaagcatcagtatttttaaaaagtttccggatgattccaatgaacaaccaagttgagaacccctgacctctgttaagtatgccagctaatgtttattgagccctcactgtgtgcttgcagcggtgccacgtgtttcccacggatcatctcattctatcctcacaacaaccccgtggggaattattactagcttcattttatagatgaaaaaaccttcatgcattacggaggctaagctgcccgagttagcagagcttagtaagaggtggagctggttaggaagtcaatgcagggggtctggctcta

SEQ ID NO: 389890 - DNA, 1962 bp, Homo sapiens
ccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgccccggagaggccatggagctgagcagcaagaagaagcttcacgccctgtccctggccgagaagatccaggtgctggaactcctggatgagtccaagatgtcccagtcggaggtggcccggcgcttccaggtttcccagccccagatctcgcgcatctgcaagaataaggagaagctgctggcggactggtgcagcggcacagccaaccgagagcgcaagcgcaagcgggagtccaagtacagcgggatcgacgaggctctgctctgctggtaccacattgcccgggccaaggcctgggacgtgacggggcccatgctgctccacaaagccaaggagctggccgatatcatgggccaggacttcgtgcccagcatcggctggctggtccgctggaaacgccgaaacaacgtcggctttggggcccgccatgttcttgcgccttcattcccccctgagccacctcccccggggctcacatcccaggctcagctgcctctttccctaaaagacttctctccagaggacgtgtttggctgtgctgaattgcccttgctgtatcgggcagtgcccggcagctttggtgcatgtgatcaagtacaggtgctgctgtgtgccaacagcaggggcaccgagaagcggcgggtactgctgggtgggctccaggctgccccgagatgcttctttgggatccgcagtgaggctctgcctgcctcctaccacccggacctgggcatcccctggttagagtggttggcacagtttgaccgggacatgggacagcagggccgacaggtggctttgctgctggctgcccgagtggtggaggagctggcaggcctgcctgggctctaccacgtgaagctcttgcctctggccgcctctagcaccacgcctcccctgcccagctcagtggtccgggcctttaaggcccattaccgacaccggctgttgggcaaactggctgccatccaaagcgagagggatggcacctcgctggccgaggccggggcaggcatcaccgtgctggacgccctgcacgtggcgtctgccgcctgggccaaggtgcctcctcagctcattttcagcagcttcattcaagaagggctggctcccggcaaaacgcccccgtcctcgcacaaaacctctgagatgccaccagtccccggcgggctgagcctggaggagttttcccgctttgtggacctggagggtgaggagccaaggtctggagtatgtaaggaggagataggcactgaagacgagaagggggacagagagggtgcctttgagcccctgcccaccaaagctgatgccctccgggccctgggcaccttgaggaggtggtttgaatgcaacagcacttctcctgagctattcgaaaaattctacgactgtgaggaggaggtggagcggctttgctgcctatgaaggcgccttcactgcttgccagagccccttcctctcttgtttcccatggaaacggcctcttcagaaggcagatcgggctgtctctttcctgtggaaatagaactgtcgtaaaggtgtagaagggagagaagttgggacaccaagtctgagcttggagtggcagtcgtccaaaccccaggaagagagctctaaagatggggcttcgggggtaggaatccaggatgcttagtttctagaccctgcttgaaagttctagagcctttgaaagggagttagtctagaggcagccacttagaaaggtggaatttgggctttttggacagactgcttccttgaactttgtgttaaaaacagttctgcttctgaaaataaagtttttaatcagaaaaga

SEQ ID NO: 389891 - DNA, 1964 bp, Homo sapiens
ccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgccccggagaggccatggagctgagcagcaagaagaagcttcacgccctgtccctggccgagaagatccaggtgctggaactcctggatgagtccaagatgtcccagtcggaggtggcccggcgcttccaggtttcccagccccagatctcgcgcatctgcaagaataaggagaagctgctggcggactggtgcagcggcacagccaaccgagagcgcaagcgcaagcgggagtccaagtacagcgggatcgacgaggctctgctctgctggtaccacattgcccgggccaaggcctgggacgtgacggggcccatgctgctccacaaagccaaggagctggccgatatcatgggccaggacttcgtgcccagcatcggctggctggtccgctggaaacgccgaaacaacgtcggctttggggcccgccatgttcttgcgccttcattcccccctgagccacctcccccggggctcacatcccaggctcagctgcctctttccctaaaagacttctctccagaggacgtgtttggctgtgctgaattgcccttgctgtatcgggcagtgcccggcagctttggtgcatgtgatcaagtacaggtgctgctgtgtgccaacagcaggggcaccgagaagcggcgggtactgctgggtgggctccaggctgccccgagatgcttctttgggatccgcagtgaggctctgcctgcctcctaccacccggacctgggcatcccctggttagagtggttggcacagtttgaccgggacatgggacagcagggccgacaggtggctttgctgctggctgcccgagtggtggaggagctggcaggcctgcctgggctctaccacgtgaagctcttgcctctggccgcctctagcaccacgcctcccctgcccagctcagtggtccgggcctttaaggcccattaccgacaccggctgttgggcaaactggctgccatccaaagcgagagggatggcacctcgctggccgaggccggggcaggcatcaccgtgctggacgccctgcacgtggcgtctgccgcctgggccaaggtgcctcctcagctcattttcagcagcttcattcaagaagggctggctcccggcaaaacgcccccgtcctcgcacaaaacctctgagatgccaccagtccccggcgggctgagcctggaggagttttcccgctttgtggacctggagggtgaggagccaaggtctggagtatgtaaggaggagataggcactgaagacgagaagggggacagagagggtgcctttgagcccctgcccaccaaagctgatgccctccgggccctgggcaccttgaggaggtggtttgaatgcaacagcacttctcctgagctattcgaaaaattctacgactgtgaggaggaggtggagcggctttgctgcctatgaaggcgccttcactgcttgccagagccccttcctctcttgtttcccatggaaacggcctcttcagaaggcagatcgggctgtctctttcctgtggaaatagaactgtcgtaaaggtgtagaagggagagaagttgggacaccaagtctgagcttggagtggcagtcgtccaaaccccaggaagagagctctaaagatggggcttcgggggtaggaatccaggatgcttagtttctagaccctgcttgaaagttctagagcctttgaaagggagttagtctagaggcagccacttagaaaggtggaatttgggggctatttagaaacggacagcttcctgtaggactgttgtagttgtaagagcggttggttgcgctttggagattttagacagg

SEQ ID NO: 389892 - DNA, 228 bp, Homo sapiens
tatgaggcctcctaataagacattaacaatttcaagaaggtaacattagaacattcaactaatcacgaggaccttctggttgtggaaccttgtgctgaccctgatattatgcacagaatacgtgtccatgaagctgaccctaacattaagaggtcaccactgaaactttcttgattggtgtctgacgataatgagcacagactttcctaaagcagtttattcttctat

SEQ ID NO: 389893 - DNA, 329 bp, Homo sapiens
tttactgtgctcttttctcagttttgaatagcattaccacatcctgaatctcccatttttagagagaacctcccatggctctaagatgcttcaaagcttcaaatcaaccttgcttgaaaaactcttactagatacttcttttaatttctttctctaatagaagaggcctttacctatgtgttggttaatgaaaggtagtttttctgcctcagtgtcaacttggaggtctcttccttgtgtactgtatcgtacttacaactcagaaacagaaggagaaatcacataccaccacaataacactgaatagaataaaaaatcagtgatgggct

SEQ ID NO: 389894 - DNA, 247 bp, Homo sapiens
atccacatgactcagcctcccaaagtgctgggattacaggagtgggccaccaaagcctgtaaagcctggccaaagacttcacttttttagagcagttttaggttcacagcaaaattgaaaggaagatacacagatttcccatataccctctacccccaacacatacacagcctcccccattactcacataccctagcagagtggtgcatttgttacacttgaacttacatggacacatcattatcac

SEQ ID NO: 389895 - DNA, 224 bp, Homo sapiens
ctggtgtggttggccatcatgcgcccactgacccggtgggccaagggcaggtaaggagacttcctcgacagggccacctggatgctggtggggcccaacaggatgaagttggccaacttccattcccggatcctctgcaggctcttgtggacctgggtggggtccacctctccctggatggtgttgaggatggtgatgtaggagtggttggtctggcggtctcg

SEQ ID NO: 389896 - DNA, 189 bp, Homo sapiens
aaactgaatactttctaaagtacagaaacaaataggcctccccttctccctttggaagacccacaggactagccataccctgctaccacccccagccccagccagatcacttccctctgaccaggctggagagtggaaggcaaggacacccaacatgctgcattccagtacagctcttctgagtcaaaa

SEQ ID NO: 389897 - DNA, 413 bp, Homo sapiens
accctaggaggcgtgtgtcagaggaacaggcagaggcaaaggcgttccttagaagtcagtctttaggctggcaggccaggagcccacgctgcgtccccgctctgaggggcagcaaagagctgctttgtggcaaacagaacatgtcccactcctgcagggcggccatctcaggtgcagctcacacccaacatgtgcagaatgggcaggactcggtgcccccagagacttcctgggtgggctccagggcctgagcctcagggtcagggccacatccctcccgctccccaccaggccctccctctgcttctgctctgagctttggtgaagaaagcctgagttggcttcccttacgcggccaggacagctttacagggctggctcccagcaattcgcatggaaggtgctgccaacct

SEQ ID NO: 389898 - DNA, 354 bp, Homo sapiens
tgcacttccaccagctatgtatgagacttcccattgctccacatctccagtattttatgtggtcagtccttttgtttttggtcattttggtggatatgaaatggcatctcagtgtggcttttcattatatttccttgatgactaatggtattctttcaccctttcagtgcttattggccattcatgtatctttgttttttgtgtagcacttcaggtcttttgcccatagatttagtgggttgattgctctttattaatgatttgtagggatgttatatatattctggacacaagattattgttagagatacgtacttcagatattttctcccagtctgtagcttgcctaattat

SEQ ID NO: 389899 - DNA, 309 bp, Homo sapiens
cccaagtgggcagtactagggctagctcggtttagttcaactaatagttattgagactctagggtgtacaaggcacatgctttcaattgaaagtgatggagtggggaggaagagagaagaatatcttgcttaactcataataccaattaggtcagaacccagcaagtttgatattggtaggaaagtaaaatatttggtaaatcatgggataaatcaagaagttacagtctccaatgtctattcatggttgaagcaggagtaatgtaaaaatggacttggagattattgccacagtgataaatagaattt

SEQ ID NO: 389900 - DNA, 725 bp, Homo sapiens
aacggcagctggctgctttctgttggcatgcagtgtggtgtttgttcttttgctctttgcaataaatcttgttgctgctcactgtttgggtctgcactgcctttatgagctgtaacacttattgtgaaggtctgcaggttgactcctgaggccagggagaccacgaacccaccggtaggaagaaactctggacacatccgaacatcagaaggagcaaactccagacacaccatctttaagaactgcaacactcaccggagggtccgcggcttcattgttgaagtcagcgagaccaagaacccaccaattccagatgcagtctcacctgtatatggaatttaataaagccagactcatggaagcagagagtagagcagaggttgccagaagcttggattggaggtaaatggggagctgttggtcaaagggttaaaaaaaggcaagagtgacaaattgtattaaaaaaattatttaaaatgtgttttgacacatcatttttatgataataatgtttatttatacctttaacctaatataattcaaatttatactgacatcctcccatctgctccttctgaaggacaaagtcatctgtcattgatttagagttcccagggtattatttaattagggctttgtaattaataacaacaaggaaacatatttttgacatttttgacaaaaatattttttccccttctagcctggcagaatcaattatgtat

SEQ ID NO: 389901 - DNA, 572 bp, Homo sapiens
cttgagagtcccaggtcgacttcagactgctgtgctggcagcaagaatttcaagccagtggattttagcttgctgggctctgtggcggtgggatccactgatccacttggctccctggcttcagttccctttccaggagagtgaacagttctgtcgctggccttccaggtgtcactggggtatggaaaaaaaataaaaaaaaaaaacagcagaacatagaataataaaaactgcatacaaatcccctgtagaaatgggggagcggagaaagggcaggccgcatgggggcagagtgctcacctttcatagtggggctggattatgagtaggtaacgatggcgtagatctgaacaaacctccagttgaagagctcagaaatgagtgaggtatgcttactatgggctgtccaggagatggcgctaggggaaaacaggctggcgaccgcagtagttgagggttcctctgaggaggggactttggctttacattttatagtttgagtactttgttttcttgccatgtgttacttttatttgcggcaggagttgggggtggggcgacggggaatggta

SEQ ID NO: 389902 - DNA, 495 bp, Homo sapiens
ctctgccttagtcacaccacactggagagtgtttccatggccactgcattgcagagcggagatcatgccactgcactccagccttggggacaaagcgagactccgtctaaaaaaaataaaaaaaaaaaacagcagaacatagaataataaaaactgcatacaaatcccctgtagaaatgggggagcggagaaagggcaggccgcatgggggcagagtgctcacctttcatagtggggctggattatgagtaggtaacgatggcgtagatctgaacaaacctccagttgaagagctcagaaatgagtgaggtatgcttactatgggctgtccaggagatggcgctaggggaaaacaggctggcgaccgcagtagttgagggttcctctgaggaggggactttggctttacattttatagtttgagtactttgttttcttgccatgtgttacttttatttgcggcaggagttgggggtggggcgacggggaatggta

SEQ ID NO: 389903 - DNA, 807 bp, Homo sapiens
tgcaacgatgaggcttaatataggtataccttacaaactaaagtgctgtgtggatatatccagctcaaaacaacacacccccacggtggaatgagaacgcagtcatccttctgtgtactcaaggatatactcatcgtataacaaaatccgtgaatactcaagtcccgcatttggctctgtggatctgcagataccaaaagtcagccatccaaatatggaggtatcatattccccaatgctatactattaatccatgtttcatttaaaaaaaattctcatataggccgggtgcagtggctcacacctgtaatccagcactttgggaggctgagatgggcgcatcacaaggtcaggagttagagaccagcctggcctacatagtgaaaccccatctctactaaaaatacaaaaattagccaggcatggtcccagatatttggtaggctgaggcaagagaatcacttgaacctgggaggcaaaggttgtggtgagccaagatgacgccactgcactgcagcctgggcaacagagtgagactctgtctcaaaaaaagaaaaaagtcctcctcatataagtggacactcacagttaaaacctgtgttgttcaagggtcaactgtatattctcaataattaattatcctgcagcccatcgtcttgcatattctgacatgttgcttaaaatgttctcaagtgattacatttgtgtatatttaatctttctaaccatatagttacttgtctgaagttcaagtcctcccttgatttgtatctgttcagagcagctagtcaagtcttttgcatctga

SEQ ID NO: 389904 - DNA, 1348 bp, Homo sapiens
tagcttcaagccactgaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaattgagaatctgtgcagtcatcaacaaaagggagaacatggccaatagtcatatgtgaagacagagcagatcagtctttgtcaatgctctaacaaaccg

SEQ ID NO: 389905 - DNA, 3615 bp, Homo sapiens
tactaaaatgtagccccaaaatgacgggccagcctcagcgtatctgccatatgtatttcaaagattacagtcagaatgagttaatgaaaatggcaggttccttttcaaagtttatttgactcacagccatattgctaagtttgggtatagtgaagttaacaacaatcacttaaattaatatcttacagcaagatatactgatactgttttaaatgaaaaagactgtaaattcaatgtaaatattacctaactttatgtaccaagttaggagagtggaagaggggaatttttcaaaaaataagctgtatttgaacaaagcatgaaacttgttgttttaaaatttaagaataattgaatttaccatctaattggcatccgtactgtgcattgatagtaatatccaaatcatcttattcttccatagaggaagcgctcatataaatcacattgctgagaactatataaaactacatagaggtaaatggtgcttattaaatatgagtatagtttgttacttgctggaagtcttctagttcatttggaccattttcttaccctgaggtgaactcaatatctgttggcaatgggtggttaaatgtgaagtgcccttgttcagtgtcccttgttcttgtacaggtattttcttagtttaaaaaaaaaattctagcatgccaacatttgtctttggcctattcctttttttctgaagtgtgtaacttctgattttttctttgctatgttgtaaataacagtagctaaattctctgttttactatctacttttcttttcttcccagatcatttcattctaaaattaaattgcttggttttctttagaggaaattgctacatggtatacttgtagtagtgattcatattaaaaaaatagctggtaaatctttctaggtagtaacttatccaaacaatactttgagtatcatattttgtgaatgacttgcttaaactgggaaactgaatattctttttaaatcatataattcctgtattaaatgtgaaacacacagtctccaaagtcacctgattctctgtggaaaatgaaaggcattgaaggaaaccagatacattaatacttagttttggttgaaagtgcaacattactgtacttagaaggggcttggtttatttttagatatttaagctatcattaattttagaccaatggctaataataagagagatttttggttgctcatttatggagagacaaagaacagcatggcataaacaaacatcccagaaataaatgaaaagttttaagtgataaaattgtgttttctatgaaccagtgttgtacatgaaccaacattgtgtttcttagctctgacctgtacagtgaggtacctgtcaggacccctagtcttggcactggaaatgacaaagttctcctattactaaattctcatgccttccttttctgacttagtagattgaaattggtaggtactaatgatttatgtttgataaacttaagttctgctgatatcctgttactggtaattctggtaccaaaatttcaaacggtttgattattagtagcattttgagtacctaggtgcatataatacagttagcagacccttacagagtcaaaagagattttggaatctggtgatactgttgtttattacactagcctattacattttctttctttataataactgtttatgtgagtttcattgaaaatcgtggctctattgctttattcatggtttccacaactctttttgtaacaccttaattttctctcttaggtattttcctgttaaataagatatcaaaagcatcaatcacaagacagagaaaacgtattaggaaaaacttgtattagtatattctaaactgaaatggaaaaactcattattcatattttaataaataaaactcccaaatgatcttgctaaattatcccactatttagaagtagaaaataagagaagagtgctttcaaggaaatttgtcatattctcccttctatctagaagttgacaatgaattgcaataaaactaagaaataactgaatgctgaaaaataccatgaattaatgttatggcttctttatttttgtatatccattcccacaaaattgaatttaagattattaatgaaaattctatattaagtaataatgcttgtattagtaatgggcaaagaagtctttctttgttacattaaccgttagtaaaagatgtactttgacatttctgatgtaaaacctatatgtaaatattgtaatttaaatatgattggacagctgttaagttttggggagggaagcagatgccagcgttctctgctgaaaagacaagatggcgcttgacggaccacagcagatggagctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaaaacctctggaggcggcaggtgcacgggaatgaactaaatgttaaagtgtgcctattacaggaggagctacagctgctgcaggaataggactcctgtgtcagggaagtagtccaggccatgggtaagaagaaagtgttggtcaaggtgcatctcaaggacaagtttgtcatagatgtggacaaaaatatcagcatcagtgatgtgacacccagttccttggtggttctaagaaatgacagctacactttgcacaagatcctacccaacaaggtggactcattggtgtcactgatgatggtgaagaaagtaccagattcagcttatgaaatgattggtagactggataggcagatcaagaagatcaaagaagtgatcgacctgcctgctaagcatcccgagctcttcaaagcactgggcattgcacagcccaagggaatgctgcttggaagagactgttggcctgggctctggctcatcatagggactgtgtacctttattcatgtctctggctctgaattggtacagaaattcattggggaatttctgtgatggcagagaaaatgctcatctgtcatcttcatggatgaaattgactcttttggctcctcagagctggagggggatgctggagggaacagtgaagtgcagcagatgatgcttcgagggtggctttgaggccaccaagagtatcacggtttatcacggctgctaatacgattgatatcctggactcggcactgctttgcccagggcacattgacagaaaaattgaattcccaacctgcaatgagtaggcctggctggtcactttgaagattcattctcagaaatgaacctgacccaggggatcaacctgagaaaaattgctgagcttatgccaggagcatcaggctgaagtgaagggcatgtgcacagaaaccggcatgtatgccctgagtagcgagtccatgtcactcagaaggactttgaggtagtccaaagtcctatctcatgccaaaggacagtgaggaaaaacatgtccatcaagaaactatggaattgagggcacatcctttgtgtgtatccctacaataaaactcagtgggacaagca

SEQ ID NO: 389906 - DNA, 3747 bp, Homo sapiens
tactaaaatgtagccccaaaatgacgggccagcctcagcgtatctgccatatgtatttcaaagattacagtcagaatgagttaatgaaaatggcaggttccttttcaaagtttatttgactcacagccatattgctaagtttgggtatagtgaagttaacaacaatcacttaaattaatatcttacagcaagatatactgatactgttttaaatgaaaaagactgtaaattcaatgtaaatattacctaactttatgtaccaagttaggagagtggaagaggggaatttttcaaaaaataagctgtatttgaacaaagcatgaaacttgttgttttaaaatttaagaataattgaatttaccatctaattggcatccgtactgtgcattgatagtaatatccaaatcatcttattcttccatagaggaagcgctcatataaatcacattgctgagaactatataaaactacatagaggtaaatggtgcttattaaatatgagtatagtttgttacttgctggaagtcttctagttcatttggaccattttcttaccctgaggtgaactcaatatctgttggcaatgggtggttaaatgtgaagtgcccttgttcagtgtcccttgttcttgtacaggtattttcttagtttaaaaaaaaaattctagcatgccaacatttgtctttggcctattcctttttttctgaagtgtgtaacttctgattttttctttgctatgttgtaaataacagtagctaaattctctgttttactatctacttttcttttcttcccagatcatttcattctaaaattaaattgcttggttttctttagaggaaattgctacatggtatacttgtagtagtgattcatattaaaaaaatagctggtaaatctttctaggtagtaacttatccaaacaatactttgagtatcatattttgtgaatgacttgcttaaactgggaaactgaatattctttttaaatcatataattcctgtattaaatgtgaaacacacagtctccaaagtcacctgattctctgtggaaaatgaaaggcattgaaggaaaccagatacattaatacttagttttggttgaaagtgcaacattactgtacttagaaggggcttggtttatttttagatatttaagctatcattaattttagaccaatggctaataataagagagatttttggttgctcatttatggagagacaaagaacagcatggcataaacaaacatcccagaaataaatgaaaagttttaagtgataaaattgtgttttctatgaaccagtgttgtacatgaaccaacattgtgtttcttagctctgacctgtacagtgaggtacctgtcaggacccctagtcttggcactggaaatgacaaagttctcctattactaaattctcatgccttccttttctgacttagtagattgaaattggtaggtactaatgatttatgtttgataaacttaagttctgctgatatcctgttactggtaattctggtaccaaaatttcaaacggtttgattattagtagcattttgagtacctaggtgcatataatacagttagcagacccttacagagtcaaaagagattttggaatctggtgatactgttgtttattacactagcctattacattttctttctttataataactgtttatgtgagtttcattgaaaatcgtggctctattgctttattcatggtttccacaactctttttgtaacaccttaattttctctcttaggtattttcctgttaaataagatatcaaaagcatcaatcacaagacagagaaaacgtattaggaaaaacttgtattagtatattctaaactgaaatggaaaaactcattattcatattttaataaataaaactcccaaatgatcttgctaaattatcccactatttagaagtagaaaataagagaagagtgctttcaaggaaatttgtcatattctcccttctatctagaagttgacaatgaattgcaataaaactaagaaataactgaatgctgaaaaataccatgaattaatgttatggcttctttatttttgtatatccattcccacaaaattgaatttaagattattaatgaaaattctatattaagtaataatgcttgtattagtaatgggcaaagaagtctttctttgttacattaaccgttagtaaaagatgtactttgacatttctgatgtaaaacctatatgtaaatattgtaatttaaatatgattggacagctgttaagttttggggagggaagcagatgccagcgttctctgctgaaaagacaagatggcgcttgacggaccacagcagatggagctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaaaacctctggaggcggcaggtgcacgggaatgaactaaatgttaaagtgtgcctattacaggaggagctacagctgctgcaggaataggactcctgtgtcagggaagtagtccaggccatgggtaagaagaaagtgttggtcaaggtgcatctcaaggacaagtttgtcatagatgtggacaaaaatatcagcatcagtgatgtgacacccagttccttggtggttctaagaaatgacagctacactttgcacaagatcctacccaacaaggtggactcattggtgtcactgatgatggtgaagaaagtaccagattcagcttatgaaatgattggtagactggataggcagatcaagaagatcaaagaagtgatcgacctgcctgctaagcatcccgagctcttcaaagcactgggcattgcacagcccaagggaatgctgcttggaagagactgttggcctgggctctggctcatcatagggactgtgtacctttattcatgtctctggctctgaattggtacagaaattcattggggaatttctgtgatggcagagaaaatgctcatctgtcatcttcatggatgaaattgactcttttggctcctcagagctggagggggatgctggagggaacagtgaagtgcagcagatgatgcttcgagggtggctttgaggccaccaagagtatcacggtttatcacggctgctaatacgattgatatcctggactcggcactgctttgcccagggcacattgacagaaaaattgaattcccaacctgcaatgagtaggcctggctggtcactttgaagattcattctcagaaatgaacctgacccaggggatcaacctgagaaaaattgctgagcttatgccaggagcatcaggctgaagtgaagggcatgtgcacagaaaccggcatgtatgccctgagtagcgagtccatgtcactcagaaggactttgaggtagtccaaagtcctatctcatgccaaaggacagtgaggaaaaacatgtccatcaagaaactatggaattgagggcacatcctttgtgtgtatccctacaataaaactcagtgggacaagcaaaaaaaaaaaaaaaaaaaagttttggggagggatgatctgctagtgtataatcaataacttttaacatttagcttgtatttagtaacatttcattgtgttttgaaaaaaagtaaaaaatcttttgaagcaca

SEQ ID NO: 389907 - DNA, 2449 bp, Homo sapiens
tactaaaatgtagccccaaaatgacgggccagcctcagcgtatctgccatatgtatttcaaagattacagtcagaatgagttaatgaaaatggcaggttccttttcaaagtttatttgactcacagccatattgctaagtttgggtatagtgaagttaacaacaatcacttaaattaatatcttacagcaagatatactgatactgttttaaatgaaaaagactgtaaattcaatgtaaatattacctaactttatgtaccaagttaggagagtggaagaggggaatttttcaaaaaataagctgtatttgaacaaagcatgaaacttgttgttttaaaatttaagaataattgaatttaccatctaattggcatccgtactgtgcattgatagtaatatccaaatcatcttattcttccatagaggaagcgctcatataaatcacattgctgagaactatataaaactacatagaggtattttcctgttaaataagatatcaaaagcatcaatcacaagacagagaaaacgtattaggaaaaacttgtattagtatattctaaactgaaatggaaaaactcattattcatattttaataaataaaactcccaaatgatcttgctaaattatcccactatttagaagtagaaaataagagaagagtgctttcaaggaaatttgtcatattctcccttctatctagaagttgacaatgaattgcaataaaactaagaaataactgaatgctgaaaaataccatgaattaatgttatggcttctttatttttgtatatccattcccacaaaattgaatttaagattattaatgaaaattctatattaagtaataatgcttgtattagtaatgggcaaagaagtctttctttgttacattaaccgttagtaaaagatgtactttgacatttctgatgtaaaacctatatgtaaatattgtaatttaaatatgattggacagctgttaagttttggggagggaagcagatgccagcgttctctgctgaaaagacaagatggcgcttgacggaccacagcagatggagctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaaaacctctggaggcggcaggtgcacgggaatgaactaaatgttaaagtgtgcctattacaggaggagctacagctgctgcaggaataggactcctgtgtcagggaagtagtccaggccatgggtaagaagaaagtgttggtcaaggtgcatctcaaggacaagtttgtcatagatgtggacaaaaatatcagcatcagtgatgtgacacccagttccttggtggttctaagaaatgacagctacactttgcacaagatcctacccaacaaggtggactcattggtgtcactgatgatggtgaagaaagtaccagattcagcttatgaaatgattggtagactggataggcagatcaagaagatcaaagaagtgatcgacctgcctgctaagcatcccgagctcttcaaagcactgggcattgcacagcccaagggaatgctgcttggaagagactgttggcctgggctctggctcatcatagggactgtgtacctttattcatgtctctggctctgaattggtacagaaattcattggggaatttctgtgatggcagagaaaatgctcatctgtcatcttcatggatgaaattgactcttttggctcctcagagctggagggggatgctggagggaacagtgaagtgcagcagatgatgcttcgagggtggctttgaggccaccaagagtatcacggtttatcacggctgctaatacgattgatatcctggactcggcactgctttgcccagggcacattgacagaaaaattgaattcccaacctgcaatgagtaggcctggctggtcactttgaagattcattctcagaaatgaacctgacccaggggatcaacctgagaaaaattgctgagcttatgccaggagcatcaggctgaagtgaagggcatgtgcacagaaaccggcatgtatgccctgagtagcgagtccatgtcactcagaaggactttgaggtagtccaaagtcctatctcatgccaaaggacagtgaggaaaaacatgtccatcaagaaactatggaattgagggcacatcctttgtgtgtatccctacaataaaactcagtgggacaagcaaaaaaaaaaaaaaaaaaaagttttggggagggatgatctgctagtgtataatcaataacttttaacatttagcttgtatttagtaacatttcattgtgttttgaaaaaaagtaaaaaatcttttgaagcaca

SEQ ID NO: 389908 - DNA, 670 bp, Homo sapiens
caaaatacctcagactggatcatttataaataacagaaattcattgcttacaactctggaggctgggatgtccacgttcaaggcatcagcagattttgtgaggacctactgtgtgctatctatggcagaaggggaaaaacaagctttcataggcctcttttataaggacactaatctcatttgtgaaggagggccctcgtgacctaatggcctcttaaagacctcacctcataatacagttgcactggggattagatttcaacatacgtattttgagtggacacaaacattcagatctagcaccatgtcctagtcataagacatagatgagattgagagagttcaggttgcttgtttaggagacatgctatacatttcaccaatctctttcttcggttttctaggatttataaaaaccattcagtgattttagtccagtcttataacgtgtccctggcctgtcctgtacctcagcgtagaccagctcaagtggtgatgaactttccggagttgcactatcacacatactaatatggctgcttctaggatcttctggtttaccgtcaaattctagctcccagtttaaaatggccaaatacctgtccagcaatcttaaagtttggttcaagtattcgtaaaaatatggaatatgccttattgaggaatatgt

SEQ ID NO: 389909 - DNA, 203 bp, Homo sapiens
gtgtgcatgtgtaaatgtgtgtgaatgagtgtgtgtgcaagtgtgtttgtgtgagtgggagtgcaagtgtctgggtcagtgtgagtgcgtgtgggtgactgtgtaaatgtgtgtatggatgagtggtttgtgtgcacatgcgtgtgtgtaaaagtgtgtgtgcatgcgtgtgtgggagtgcaagtgtgtggatcagtgtgtat

SEQ ID NO: 389910 - DNA, 647 bp, Homo sapiens
taccagttaagttcactgttttactgggtgtcatttgtggtgccccccaaacaattacaataataactcaaagatcactgagcatagatcaccataaaggagagaataataatgaaagagtttgaaatattgtgagaattccaaaatgtgacacagagacacacagtgagaaaaatggtgctgatagacttgctcaatgcagggttgccacaaaccttcaatttgtaaaaaatgcagaggctatgacatgcaataaagcaaaatgcaacaaaacaaggtatacctgtatttgcttttggccttctttgccttgcctccaattgaaaatttggataatgaccttgtctttcatgactagttgacagcaggtattgtggacaactcccagtgactcagtccatcctgattaatttagactttgttaacaatggaactgtgtaggactggacttgagtttattctccatactttggatttgatgttttttttcatcctcagggagccagttatccttctgtgagtatctctcaacttcacttactttggtgcgatctaggcccttcatccaggcttcatctcttcaaaagagttcccagcatgttttcctgcttatgagttattccagtcacaaattcatccagccgtct

SEQ ID NO: 389911 - DNA, 331 bp, Homo sapiens
tgtgtagaaacttttactcttagctttggaatccattgtagtaatgagtctccttaaattgttttttcctaagtagtattgatttgtaactgacaagtgcaggcttatgctctttcttaatctctttcatcaagcaatattttccaattttgatgggattagttcttttattctactagaccgccataaaggaggcttttctggagaaaatctgccttttaaaatcttcaatgcccattttttctagtaaccatcttcaggctctctacataaagtccacgaaagcatcacctttatcagtttcatttattgttatatgtccaacacccag

SEQ ID NO: 389912 - DNA, 390 bp, Homo sapiens
gctggagataaaagccacgctttgcatggtttgttcgtaaggctgcaagagctggctgagaaagacagcggatactcaggattgcgacatgctattagtcacagtgtgttccaggagagctcacaaatgctttgaaacagttacaggatatttctaaggatatttagcttggacctaagaggcctgtctcatgggcaatgatggtttgccccccacccctagaagacgaaatttgccagaaactaaaactcagtccctgtggtatttctcatccaaaattatttctagccacattgtctagtgcaacttttcagaggttctgcaatgatataaaatgtcaacataataatgttcaaataaattaaatgcccttgtaggtcataatccaaa

SEQ ID NO: 389913 - DNA, 388 bp, Homo sapiens
ttttttttgtatttttgatagagacagagttttgctatgttgcccagggtgatctcaaactcctaagctcaggcgatccacctgcttcagcctcccaaagtgcagagattacaggcgtaagccagggtgctggccctcccctcaccatctgactcattccctttcaagtgtcacctctgtgttgatgcctccctgctagcttttgttttcatttctgctttactctgaaagtggcctgttccctcacttggccattctcacaaaagcgtcacttgggctgagaaatatcattcatgttgcctcagttcctataatcagttaccaggtctttcattctagctgtataatatttcattcattcattcattcattcactcgtctgacatta

SEQ ID NO: 389914 - DNA, 219 bp, Homo sapiens
aacccaggaggcagaagtttcagtgagctgagatcatgccattgcactctagcctgggcaataagtctcaaataaataaataattaaaaaagatacttaattttttttttaagtaacatgaaagtacaaagaagaaaattgaaacttaccagattctctgtcaattgtcagtgatattaacaaacataataatgttcaccaaatgccattggatacaga

SEQ ID NO: 389915 - DNA, 626 bp, Homo sapiens
gattacaggcctgagccactgcgcccggctgttatatacatccttctcgttattcctctatcatagcttactatttttaaatattaaatttctgtttgcattattgtatggtttctctctcctgattagacacagactaataaaacatttagtaattattttcctccatctcatatatccgtctgagtcgtaaacatcttttataccaaagacctatttaatccttcagcactatctctgtgttttgcaaataaccagcaattaataagtgatttgagtttgccgctattggagttattgttgctgtcatagagagatggaggagtgctgatgtggagggtggttataatgggtatttatttgacctttcttagaaaaacaacccaaagttcttactctgttactaatgggttaacttagtgttgctgtgaaagtctgtaactgttaagacaattacgcattgttgactcaactgttgaaaactacattttaaggcatctatataaagtcttcagaattatgtaaacagtgatttactgctacctatttgtcttcattgaccttttaaaaacaaattccttgcacaggcaagccttagagccaatggtgcctacaggttacctgta

SEQ ID NO: 389916 - DNA, 370 bp, Homo sapiens
ttaggaatttaatccattttgaggtaatttttgtgcatggtaagagataaagttctaattatattcttctgcatgtgaatatccagttttcccggcacaaatttatgaagagattgtcctttctcccattgtgcattgttggcacctatgtcaaaagtcaattgaccataaattcatggatttatttctgggctctgtattctcttccatttgcctatgtgtttgtttttatgccagtatcatgctgtttggattctatagctttgcaatgtatttcaaatcaggaagtataatgctttctgctttgttctgtttgctaaagatcactttggctattcagagtctttcgtggtttaatcttccataagta

SEQ ID NO: 389917 - DNA, 707 bp, Homo sapiens
ctaccacaaaaccaactaataccacacccaagaatatgtcgagaggggtggtgttcttcaggacccttcaaaaaatgatactatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctggtcttgaactcctgacctcgtgatccacccgcctcggcctcccaaagtgctgggattacaggcgtgagccaccacgccc

SEQ ID NO: 389918 - DNA, 2823 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttc

SEQ ID NO: 389919 - DNA, 4043 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389920 - DNA, 2808 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagtcgcaacaacggttcctcatggttttccggacaaggggggctgttccgcaaaaagggggaaaaaggccagtacaggggagcctaagaaataaa

SEQ ID NO: 389921 - DNA, 2063 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctggtcttgaactcctgacctcgtgatccacccgcctcggcctcccaaagtgctgggattacaggcgtgagccaccacgccc

SEQ ID NO: 389922 - DNA, 2049 bp, Homo sapiens
  misc_feature (1951)..(1951): n is a, c, g, or t
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggggcggcaacgggaaagttctttcccttcttaggaaattttaaaatgntagcgggggggggccgcggaccggccttggagccgggggaaactcgggcaattaaacacgggatggaactttgtttaaaagtgtctctaaggggccca

SEQ ID NO: 389923 - DNA, 2852 bp, Homo sapiens
atgtctggccaatcgtcttggctccaagggggaagaatgcaactggcaggattcgaggagagggcacttctgcagcccccaagcaagtctctagttttcgccccaaagtggatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389924 - DNA, 2687 bp, Homo sapiens
ctaccacaaaaccaactaataccacacccaagaatatgtcgagaggggtggtgttcttcaggacccttcaaaaaatgatactatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389925 - DNA, 3305 bp, Homo sapiens
tcaccctgttagaactgtatatgctttgtgtgtatgtgtatccttattagtgtccaaacttaactagggattaagaggatgggtttggaatcagactgtccagctgcctttctagctttgggatttggggtgcaaagcttatatttcccttgtatgagatgagaataataaccctatttcgtaggttatcctatttcataaggattaaatctttaaaatacatatgaagcagataggatatttctggtagttatattagatatgattacttccaaatttatattgggatggatatgtttttatacatatatgaaatgtcacatacataatggtgttttttcctgtttaaaaatgtttaattgtagaatacgtgaaaagcaaaagcacaatgaagaaaatgtgagagtatccataatccctaactcagaaataaccactatatgactttgtagaaacacatatagaggcatttaaagacatcttatttgatatcatactattggttgtttttaaccttttaaaaaattactttgtaatattgtcactccaattcaaatatttttccccaactactttgtgataaaagcagttaaatttcccaaagtaaataaaaactccttgcctatataaaaacatgtgaaagctgaaagatagtgaacatttggcttaaaatattaacaactttattgctttctccccctattcctagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389926 - DNA, 2710 bp, Homo sapiens
  misc_feature (21)..(21): n is a, c, g, or t
aagaaaggaagaaagaaaagnaggagagaagaagattggaataatgggaattcttggatagacttaacctgaaatggtagcaaggacccttcaaaaaatgatactatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389927 - DNA, 3252 bp, Homo sapiens
tcaccctgttagaactgtatatgctttgtgtgtatgtgtatccttattagtgtccaaacttaactagggattaagaggatgggtttggaatcagactgtccagctgcctttctagctttgggatttggggtgcaaagcttatatttcccttgtatgagatgagaataataaccctatttcgtaggttatcctatttcataaggattaaatctttaaaatacatatgaagcagataggatatttctggtagttatattagatatgattacttccaaatttatattgggatggatatgtttttatacatatatgaaatgtcacatacataatggtgttttttcctgtttaaaaatgtttaattgtagaatacgtgaaaagcaaaagcacaatgaagaaaatgtgagagtatccataatccctaactcagaaataaccactatatgactttgtagaaacacatatagaggcatttaaagacatcttatttgatatcatactattggttgtttttaaccttttaaaaaattactttgtaatattgtcactccaattcaaatatttttccccaactactttgtgataaaagcagttaaatttcccaaagtaaataggcttaaaatattaacaactttattgctttctccccctattcctagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389928 - DNA, 2462 bp, Homo sapiens
atctcactgcaacctctgcctcccaggtgcaagcagttatcctgcctcagcctcccaagtagctgggattacaggcatgtgccaccatggctggctaatttttgtatttttagtagagacggggtttcgccatgttggccaggctagtctctaactcctgacctcaagtgatccgcccacctcgacctcccaaagtgctgggattacaggtgtgagccaccgtacccggctgtaaatggtggtatagctagctgataccacctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389929 - DNA, 3494 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggtaagaagtcagcggtttgtcttgtgtttatatttgtgtttactcaagtaggactgctttttgaaacattttttcttaacaagagaagttacaaagtatttactttttccccaagcaaaaatcctatttttctggaatttggactcagtatcatctcaggaataaaagaatagctgagtcttgaacagtaggaaacattttgctaatgcctttatacgctttttttttttaactgaaactccaaagctatgccctgtgtggttttgaaagaaattagtttatgggttcagttgtggaaaaatatcttacttttacattatgtaggacaagtgataataattgtttctgtgttggaaaaaaataattgcaaagttgttttgtttcttataggttatcttctttatctgtaatacagaggcctttctgtacttattttccaaatttaattcttttttcctgtaggctcaaacaggcccacacccttcccggttacttagtaatacagcgaaaacaaaagactaagtatttgagtgtttgaaaactttaatgtgtactacattgcataccaggaagaaaatatggaaccattttctgcctcccacatgctaggtggttcatttcccttattccctaacaattttccttaatttctgtccttcagatagctggtacacagcactctaatttaaagggacagcagtttaggtgccacctagaacataggaaagtgatgctgcctcccttccattttcctcctccttgctgcttgcttcccattcctcattgagccgaaattactgaataggtttgacacagcaattaaagttggcctagacacaagaattctattaactcaagagattgcttgcttaacagtgtctgccatctgttgccctgcaatccagagtgtttgtgtaaattaactcttccatgttgctagactgctactctgaactattgaattgtttctgaaaggggaatgaaatggttcttaaaacactttgtaacaactgttggttgtttgtcctctcctcctaacacatgtactatccattcttgaatccttaaaaaaaaaaaattaaatagttcaaaacagtattctgtaaaaagtttcttcctgtctcaagctctcagtgtcttagttccccttccctggaggtaaccagccatcattttttgttgttgcttactcttaataacttgtgttattatggtaaaatttgaacgaagcgtggccttgatttgtatattgaacatgtccagaaaataccactttcagaggtcaacatctgattcaaaggatataggagccataacacatttctgcacagcaactatgagagcatcttttatattaaaacaatagaaaaaatatgtttgcaattacaatgtctagaagtctacagattgcttcttgttgctgtttttctttcttggtagtacagttaggaccattcttaggaatgtagaacaatgttccccaaattctgttcttgtatcacctcagttggaatcccttggtatgtacatgaatatatataggaaatgtttatttcttgggcttctactcctactgctttggaatctctggagatagggtttaggaatttgcaatttaagtaatctaggtgataagtaggtagctaagcccaaactttttgctgaatgatatgcccatcttttcatttgaaaacttaggaaaatttaattctcttctgtggtaagcattgtctgccttctataggccaaaggattagagatttctcagctgaattaaaactattgagccatccaggtgcagtggctcacgcctgtaatccctacactttgggaggctgagatgggaggatggcttgagcccagcacttggagaccagcctgggcaacatggtgagaccctgtctctattttttaaaaatcataaaattagctgagcattataatgtgtgcctgcagtcccaactactggggaggctgaggctggaggatagcttgagcccgggagtttgaggctgcagtgagccatggtaacaccattgcacttccatctgggtaacacagcatgaccccatctca

SEQ ID NO: 389930 - DNA, 1420 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgtt

SEQ ID NO: 389931 - DNA, 423 bp, Homo sapiens
tagtaattatggactttaaaaactatccatatataccattctaacaagggactctgatatgctcagagtagaggtatctttctatggatcctcaaatctcccagggaattcactatcaccagaatatagtctcatgttccaaagttagaaacaagcatatagtgagaattcatttggctatgtcttaaaatattatttgttttcctttttttgacagagtgaccttaaacctgaaagtggtagcaaggtaagaagtcagcggtttgtcttgtgtttatatttgtgtttactcaagtaggactgctttttgaaacattttttcttaacaagagaagttacaaagtatttactttttccccaagcaaaaatcctatttttctggaatttggactcagtatcatctcaggaataaaagaatagctg

SEQ ID NO: 389932 - DNA, 781 bp, Homo sapiens
caaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgaggtggggcctgggaggtgggaggcctctgaagctgctggggcgaggggtgaaaaggctgtgtggagtgtatgtgggaaggaagggaggcttggctgggggcgataaggcgtaagaaagggatcacgaccctcagagggaaactggggtgggattgggggagggctttagtttgcatgcatttccagtcagctccgagttctggtgccttatgtaatatcatgtattacttatgtgtcgagcatttgctgtgtgctcagctaaactctaagccatcattatctttattttacagaaagggaaactgaggctcacaggttgaggactctcagggccatagagttagcagcttagatccgttgaacctaggtctgaagtgcacccacatctgtgcttttccagtgtgccttctgaagtaataccggttttggttttcgtcttctagagtagaagctgagatttctctccacacgcttccccatcttgattatgcctccactgtttttttttccccctaatctgagttgaccttgaggccagaaactcataaatcaacccttttttt

SEQ ID NO: 389933 - DNA, 1886 bp, Homo sapiens
gaaccaggaactattcggaagtgtgattggctgttgctaggaaccgtctcaaggccttatgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttc

SEQ ID NO: 389934 - DNA, 3397 bp, Homo sapiens
  misc_feature (2988)..(2988): n is a, c, g, or t
  misc_feature (2993)..(2993): n is a, c, g, or t
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccaaaaaaaaaaaaaanaaaanaaaaaaaaacaaatttaaaaaaaaaacaaaaaaaaaaaaaaaaaattttttgtggccccccggcgccccccaagaagagaatctttcttaaacccacactcttgcgtggtgaggcgcggccgggccccccggagtgaggtaagtcaaagaacagagtgtgagccacagaagtgtttcccgagagggaacacccggggggaaagaacaaagaggcgcggggattctctctcaccccaatataaaaaagaagcccgcggggggggaaaaaccacgaggtgttcttttggagaacaatatctccacgaaagagggagtattcgagagagggcactaacaaccggaggattcttataccaaggggaggcgttccaaaggagcaacccccaaaatttataatattcgcg

SEQ ID NO: 389935 - DNA, 2403 bp, Homo sapiens
  misc_feature (1982)..(1982): n is a, c, g, or t
  misc_feature (1987)..(1987): n is a, c, g, or t
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaaaaaaaaaaaaaaanaaaanaaaaaaaagggggggcgccgccaaaaaattctccccggggggcgccccaactgttccgcactctcaccccgttttttttgcccaagagggggcccccatgaggggggcgtattaaaaccaacggaaagcgggagcgccggctgtataaacaaggcgcggatgcggggaaaacgcgcgtccaacacgcgggaccctgctggcgagaagggaaccctgacttgcgcgggggggtggcaacaacaggtgggggcaaccatccctcaacgagacttaagagctctgcaggggcgaacatcttcacacttccgcggctgcctcgggtgctcaccccagcgggctacatgcagcggcccgcaaaactctggccccagggagacctatctcggcaaaattttcacgcgacggcgaaaaacagt

SEQ ID NO: 389936 - DNA, 1248 bp, Homo sapiens
gaaccaggaactattcggaagtgtgattggctgttgctaggaaccgtctcaaggccttatgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgcgtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttc

SEQ ID NO: 389937 - DNA, 3121 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatcc

SEQ ID NO: 389938 - DNA, 1984 bp, Homo sapiens
gtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctccacaaaatcttccatcatctgagggctgtggtggggggagggtgccaagcgcaggagctcttcaccccgggggacagttgggtagttgatggcctgcacatagatgccatgcttggagagcaggagatcacagagcttgctgttgagtgctgcattgcccacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcaccatccatggagtggacagtctcaaaggccacaattttgggtatcttagggttagacttctctagaagtttctttaggtggtcagggtcattgtgcctgaagacaaacttggctgctccacttggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaaggttagtatctccttaacagctttccatacgttcaaggtaatgtctggcaagagactcttccataagtatatgtatgtaacataacttatgagtgcagtttgacaactaattcttttttggcccaaatcattgcaaattcagttgttccttgacattagaaaaattaacttttacagtttcagccattttgaataatctaaaagtttcatgccttgagtcattttttaatcttattgtgacataaattggaatcacactcagtaagaggccaggatgcatggacaggtagctactattgggtcagcctttagtcccgaagttcaacccagctacatgattctacttaaaacttaatcgcatttacttctcacaaccactctgtaaggtaagtgctattattacatattgcaggagaaaaaaatactacggtcatatttaggaatttgggttttctcaggtttatttacaatatattccttggcattaatattagtaattcattagtattagctctgaaagttataaattgccttacct

SEQ ID NO: 389939 - DNA, 323 bp, Homo sapiens
acacacacacacacacacacacacacacacacacacacaccaaaaacaaacaaactgatttcacttgaaatatttagataactaaaaccaaaagcaaattaagtcgttctaagaggagtggtttcactcttcactattgctttatgtagacatgttcttcacatgagacattcttaatgctgggagaactgggacagattagaagaaggtggcttgttctcggttttaactggttagttaatttctactgttaatggctttttttttttgagacaaggtctcactctgtcacccaagctggagtgcagtggtgcaatctcagc

SEQ ID NO: 389940 - DNA, 420 bp, Homo sapiens
aacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttaca

SEQ ID NO: 389941 - DNA, 929 bp, Homo sapiens
agatgcaaagcttctcagcatcgcacttaccatcatcaccaccatcccaacagacgactgagagctttttgcaaggtcgcaattgacaaagaggactaggtccttgcggtttagagtcagttaagagtccgtgtgaactcaaccttgcctttggcgtttgattttcagaggtttaaaatgaacttctcattgatgtcccactctacttgacttagcaggaaaaagactagagttgaacttgctaacccaggaaaagtttgtgcctgttagttaaaaaaaaaaggggggggtggaattctaatatcaatgtttctgtaaagttataatctgtggtttacatatgttatcactgaggtccatttgtacatgtattattagattatctccagatagggatgtgtcttctatttccattttctctgccagtgcctttatttcctagaatactgtttttcatggatagtgttttcttttgtatttcatctacactttcatcctcattcccactccttatttagaaaagaaaatcaagactccgtagaggattccctccctctgaaagaatcctccttgcagtttttagttctgtcttcaaacaatatccatgctttcaaaagactaattcagtagtgctttgtgcttcctagatccggtaaatataaattacacttgttttactgattaaactaagggaagaaaagagttggtcattgtatacgccttgacctctcccaagggtcgggtctgttgatcttctgagtgtcttcttggtattttttccttatttccagtggtatgtcctacacagtgcatccttaggccaggagacgcagtaggaaaatgactctacctttcatgagaaaagggtaccagttggtattagctgatcagagagttgctttaaaaataaaatgcttatgtattgatga

SEQ ID NO: 389942 - DNA, 156 bp, Homo sapiens
tgagttgtttattagcaggacttttgctgacattttccttactgcttttttgagacctggtttgaccacccagcattggttggctcccagcaagacttgagccatacgcggccatttagacatggatcacgtgtgtgtgagcaaagaccccaaaag

SEQ ID NO: 389943 - DNA, 811 bp, Homo sapiens
ccgatcacagattgtaatggtccttacgatttaaccccaatctatcttttggttccatcttacaatgttctctttcaacctctcctctcaccctagagtccctgctaaaacatcacactgcatgtccagacacctctgggcaactctaccacccctaaatctccagccctctgtgtctttgctggtgctttttatctggttggaacacccagcatctttcaagtcaaaatattactcatttctattaaggatagagataaggtaagaagaaaacactgggtattcgtgagaatcaatccgtgagtaacagaagaaaaaggtggttgagaggttttcattttgattgtaagtattacagagtgtctttcaaacacctaaatctcaactatgtctgggagatcgtcctggtatataacactttataaattagccaactatgatagtttatcgtagttcatacttgaatggcaccatcaaggttgaaacactgagtataagatatctctctgctcattcaatgacaaaatcaggtaagaaaaattctagcatggctagaacttaacaactgcctaaagtgaaatatgccttcttgttagcagggcagcagcgtatttgcctaattacattacaggaagttacattctaatccaagattgtttcattaacattaaaaatataatattcctcttataaattgtccaggtcccatgcccaggaggcattccatttttaggtattatcctcatgtttctgattttccccaaactctaccaattacaaggtgtttcacacacccttcttgaggaacatc

SEQ ID NO: 389944 - DNA, 514 bp, Homo sapiens
cagcatacgtcagcgttttcttctatgcactgataagaaagatcaaagactttagactttcactatttcatctaccgctctgtactacgaacttcaaagaggaaccaggagtacgggaggaacatgaaagtggacaaggagcgtgagcattgaagcacagccccacagggaggggtttaggcctccggatgactgcggggaggcctggataatatccagccttccacaagaagctgctggagcagagtgttccctgactcctccaaggaaaggacactccttttcgcgatctgctaagtgatgggtgtcttcccaggcactagcgttaccgcttgaccaaggagccctcaagcggcccttatgcgagcgtgacagaaggttcacctcttgccttctaggtcacttctcacaatgtcccttcatcacctgaccctatacctgccggttattcgtaggttatattagtaatgcaacaaaaagtaatattaaaagctaatgattaataatgtctaaa

SEQ ID NO: 389945 - DNA, 351 bp, Homo sapiens
cttaattcctaataaaaaaatcacaaaatataaagtctaacgtttagtgtcatctcttattggaatatgtcagcttccccagagacaatgcattgccgcaagtaactatttgaaacaaatccttctgtgatatctgaagacactcttctgaaaggctttctcttcaagagttgcaaagcagcactttcccacccctctctgcatccagccaaacaaagcaagcaaaggactgtttctctttgacttatattttacttgttagtcattttatatcattataattctgaaataaaataagccttaagagaaaaaaatccaccacacattttatattaaatgttcattcctgag

SEQ ID NO: 389946 - DNA, 474 bp, Homo sapiens
acatgaatgtacttttaccaaaaacatcacagaatctacgatgtgttatttccatctggttaataattataactacctttggatttcttcctacatctttccacacttacttggggaaaatgcaaaaggaatatttcatcttcaccgcagtagtgcctgtgattaatgcagtcatgagctgctaacgatacaagcaagagctgcttagctttgattcaatccttaaatcacttgggaaaaaccaactgaagggggaaaaaaagaggtcggagaaggcactggaattctcttttctgttttttcaagagacaaggtctcgctatattgcccaggctggatttgaactcccaggctcaagcgatcctgcctctgcctcctgagcggttgggattacaggcatacaccactgctcccggcaacaatggaattgttaaagacagaggctggccacctgtctgacttgcttgcagttag

SEQ ID NO: 389947 - DNA, 763 bp, Homo sapiens
aatagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagaccccaatgcccccacagagcaatacactgaagcctaaacatctatctggtgtttttaaaaagttaaaagaaaaatagattttttttcacaaggtgacaatagtgatttttaccatctggatacagcctggtgtaagcagacgtccattaccaccctcacccacattttcaggtgtctacatcagccttagtcattatggatagtaaatcgacctttaagaattcctggggtggactttgcaaacacattctacaacctgatggtttttactgctcaaactgtcaccatcatcttttgcaatgtgttgctcactgttgtcaataaactaatttttcctggc
